US007635764B2

(12) United States Patent
Bledig et al.

(10) Patent No.: US 7,635,764 B2
(45) Date of Patent: Dec. 22, 2009

(54) NUCLEIC ACID MOLECULES ASSOCIATED WITH THE METHIONINE SYNTHESIS AND DEGRADATION PATHWAYS

(75) Inventors: Stefan A. Bledig, Chesterfield, MO (US); Joseph R. Byrum, Des Moines, IA (US); Jingdong Liu, Ballwin, MO (US)

(73) Assignee: Monsanto Technology LLC, St. Louis, MO (US)

( * ) Notice: Subject to any disclaimer, the term of this patent is extended or adjusted under 35 U.S.C. 154(b) by 676 days.

(21) Appl. No.: 10/959,789

(22) Filed: Oct. 7, 2004

(65) Prior Publication Data

US 2008/0005809 A1 Jan. 3, 2008

Related U.S. Application Data

(63) Continuation of application No. 09/198,799, filed on Nov. 24, 1998, now abandoned.

(60) Provisional application No. 60/067,000, filed on Nov. 24, 1997, provisional application No. 60/066,873, filed on Nov. 25, 1997, provisional application No. 60/069,472, filed on Dec. 9, 1997, provisional application No. 60/074,201, filed on Feb. 10, 1998, provisional application No. 60/074,282, filed on Feb. 10, 1998, provisional application No. 60/074,280, filed on Feb. 10, 1998, provisional application No. 60/074,281, filed on Feb. 10, 1998, provisional application No. 60/074,566, filed on Feb. 12, 1998, provisional application No. 60/074,567, filed on Feb. 12, 1998, provisional application No. 60/074,565, filed on Feb. 12, 1998, provisional application No. 60/075,462, filed on Feb. 19, 1998, provisional application No. 60/074,789, filed on Feb. 19, 1998, provisional application No. 60/075,459, filed on Feb. 19, 1998, provisional application No. 60/075,461, filed on Feb. 19, 1998, provisional application No. 60/075,464, filed on Feb. 19, 1998, provisional application No. 60/075,460, filed on Feb. 19, 1998, provisional application No. 60/075,463, filed on Feb. 19, 1998, provisional application No. 60/077,231, filed on Mar. 9, 1998, provisional application No. 60/077,229, filed on Mar. 9, 1998, provisional application No. 60/077,230, filed on Mar. 9, 1998, provisional application No. 60/078,031, filed on Mar. 16, 1998, provisional application No. 60/078,368, filed on Mar. 18, 1998, provisional application No. 60/080,844, filed on Apr. 7, 1998, provisional application No. 60/083,067, filed on Apr. 27, 1998, provisional application No. 60/083,386, filed on Apr. 29, 1998, provisional application No. 60/083,387, filed on Apr. 29, 1998, provisional application No. 60/083,388, filed on Apr. 29, 1998, provisional application No. 60/083,389, filed on Apr. 29, 1998, provisional application No. 60/084,684, filed on May 8, 1998, provisional application No. 60/085,245, filed on May 13, 1998, provisional application No. 60/085,224, filed on May 13, 1998, provisional application No. 60/085,223, filed on May 13, 1998, provisional application No. 60/085,222, filed on May 13, 1998, provisional application No. 60/086,186, filed on May 21, 1998, provisional application No. 60/086,339, filed on May 21, 1998, provisional application No. 60/086,187, filed on May 21, 1998, provisional application No. 60/086,185, filed on May 21, 1998, provisional application No. 60/086,184, filed on May 21, 1998, provisional application No. 60/086,183, filed on May 21, 1998, provisional application No. 60/086,188, filed on May 21, 1998, provisional application No. 60/089,524, filed on Jun. 16, 1998, provisional application No. 60/089,810, filed on Jun. 18, 1998, provisional application No. 60/089,814, filed on Jun. 18, 1998, provisional application No. 60/091,247, filed on Jun. 30, 1998, provisional application No. 60/092,036, filed on Jul. 8, 1998, provisional application No. 60/099,667, filed on Sep. 9, 1998, provisional application No. 60/099,668, filed on Sep. 9, 1998, provisional application No. 60/099,670, filed on Sep. 9, 1998, provisional application No. 60/099,697, filed on Sep. 9, 1998, provisional application No. 60/100,674, filed on Sep. 16, 1998, provisional application No. 60/100,673, filed on Sep. 16, 1998, provisional application No. 60/100,672, filed on Sep. 16, 1998, provisional application No. 60/101,132, filed on Sep. 21, 1998, provisional application No. 60/101,130, filed on Sep. 21, 1998, provisional application No. 60/101,508, filed on Sep. 21, 1998, provisional application No. 60/101,344, filed on Sep. 22, 1998, provisional application No. 60/101,347, filed on Sep. 22, 1998, provisional application No. 60/101,343, filed on Sep. 22, 1998, provisional application No. 60/104,126, filed on Oct. 13, 1998, provisional application No. 60/104,128, filed on Oct. 13, 1998, provisional application No. 60/104,127, filed on Oct. 13, 1998, provisional application No. 60/104,124, filed on Oct. 13, 1998, provisional application No. 60/109,018, filed on Nov. 18, 1998, provisional application No. 60/108,996, filed on Nov. 18, 1998.

(51) Int. Cl.
*C07H 21/02* (2006.01)
*C12Q 1/66* (2006.01)
*A01H 11/00* (2006.01)

(52) U.S. Cl. .................... 536/23.1; 536/23.6; 536/24.1; 435/6; 800/295

(58) Field of Classification Search ...................... None
See application file for complete search history.

(56) References Cited

U.S. PATENT DOCUMENTS

| 5,451,516 | A | 9/1995 | Matthews et al. |
| 5,512,484 | A | 4/1996 | Yamamoto et al. |
| 5,635,375 | A | 6/1997 | Kraus et al. |
| 5,738,998 | A | 4/1998 | Deth |

OTHER PUBLICATIONS

Everett et al., Nature Genetics, vol. 17, pp. 411-422, 1997.*
Scott et al., Nature Genetics, vol. 21, pp. 440-443, 1999.*

Aarnes, "Partial Purification and Characterization of Methionine Adenosyltransferase from Pea Seedlings," *Plant Science Letters*, 10:381-390 (1997).

Azevedo et al., "The Biosynthesis and Metabolism of the Aspartate Derived Amino Acids in Higher Plants," *Phytochemistry*, 46:395-419 (1997).

Davies et al., "Regulatory Isoenzymes of Aspartate Kinase and the Control of Lysine and Threonine Biosynthesis in Carrot Cell Suspension Culture," *Plant Physiol.*, 62:536-541 (1978).

Database Geneseq accession No. AAT 99143, Mar. 26, 1998 (see sequence alignment).

Database Geneseq accession No. AAX 07185, May 21, 1999 (see sequence alignment).

Database Geneseq accession No. AAA 48576, Sep. 19, 2000 (see sequence alignment).

Database Geneseq accession No. AAA 48574, Sep. 19, 2000 (see sequence alignment).

Database Geneseq accession No. AAC 47744, Oct. 18, 2000 (see sequence alignment).

Eichel et al., "Vitamin-$B_{12}$-Independent Methionine Synthase from a Higher Plant (*Catharanthus roseus*): Molecular Characterization, Regulation, Heterologous Expression, and Enzyme Properties," *Eur. J. Biochem.*, 230:1053-1058 (1995).

Espartero et al., "Differential Accumulation of S-Adenosylmethionine Synthetase Transcripts in Response to Salt Stress," *Plant Molecular Biology*, 25:217-227 (1994).

Everett et al., "Pendred Syndrome is Caused by Mutations in a Putative Sulphate Transporter gene (PDS)," *Natuer Genetics*, 17:411-422 (1997).

Galili, "Regulation of Lysine and Threonine Synthesis," *The Plant Cell*, 7:899-906 (1995).

Gengenbach et al., "Feedback Regulation of Lysine, Threonine, and Methionine Biosynthetic Enzymes in Corn," *Crop Science*, 18:472-476 (1978).

Giovanelli et al., "Aspartokinase of *Lemna paucicostata* Hegelm. 6746," *Plant Physiol.*, 90:1577-1583 (1989).

Giovanelli et al., "Regulatory Structure of the Biosynthetic Pathway for the Aspartate Family of Amino Acids in *Lemna paucicostata* Hegelm. 6746, with Special Reference to the Role of Aspartokinase," *Plant Physiol.*, 90:1584-1599 (1989).

Gómez-Gómez et al., "Hormonal Regulation of S-Adenosylmethionine Synthase Transcripts in Pea Ovaries," *Plant Molecular Biology*, 30:821-832 (1996).

Izhaki et al., "A Petunia cDNA Encoding S-Adenosylmethionine Synthetase," *Plant Physiol.*, 108:841-842 (1995).

Izhaki et al., Entrez, Accession #1084428, (May 3, 1996).

Karaolis et al., "The Sixth and Seventh Cholera Pandemics are Due to Independent Clones Separately Derived from Environmental, Nontoxigenic, Non-O1 *Vibrio cholerae*," *J. Bacteriol.*, 177:3191-3198 (1995).

Locke et al., Entrez, Accession #AF007786 (Jun. 18, 1997).

Locke et al., Entrez, Accession #2198853 (Jun. 12, 1997).

Mathur et al., "Post-Transcriptional Regulation of S-Adenosylmethionine Synthetase from its Stored mRNA in Germinated Wheat Embryos," *Biochim. Biophys. Acta.*, 1078:161-170 (1991).

Matthews et al., "Enzyme Expression in Soybean Cotyledon, Callus, and Cell Suspension Culture," *Can. J. Bot.*, 57:299-304 (1979).

Michael, Entrez, Accession #Y07767 (Sep. 10, 1996).

Michael, Entrez, Accession #1532073 (Sep. 10, 1996).

Michalowski, Entrez, Accession #1724104 (Dec. 6, 1996).

Michalowski et al., Entrez, Accession #U79767 (Dec. 12, 1996).

Muehlbauer et al., "Molecular Genetics of the Maize (*Zea mays* L.) Aspartate Kinase-Homoserine Dehydrogenase Gene Family," *Plant Physiol.*, 106:1303-1312 (1994).

Ravanel et al., Cloning of an *Arabidopsis thaliana* cDNA Encoding Cystathionine β-lyase by Functional Complementation in *Escherichia coli*, *Plant Mol. Biol.*, 29:875-882 (1995).

Rognes et al., "S-Adenosylmethionine—A Novel Regulator of Aspartate Kinase," *Nature*, 287:357-359 (1980).

Schröder et al., "cDNAs for S-Adenosyl-L-Methionine Decarboxylase from *Catharanthus roseus*, Heterologous Expression, Identification of the Proenzyme-Processing Site, Evidence for the Presence of Both Subunits in the Active Enzyme, and a Conserved Region in the 5' mRNA Leader," *Eur. J. Biochem.*, 228:74-7 (1995).

Scott et al., "The Pendred Syndrome Gene Encodes a Chloride-Iodide Transport Protein," *Nature Genetics*, 21:440-443 (1999).

Singh et al., "Molecular Regulation of Amino Acid Biosynthesis in Plants," *Amino Acids*, 7:165-174 (1994).

Venter et al., "The Sequence of the Human Genome," *Science*, 291:1304-1351 (2001).

Woese et al., Conservation of Primary Structure in 16S Ribosomal RNA, *Nature*, 254:83-85 (1975).

\* cited by examiner

*Primary Examiner*—Shubo (Joe) Zhou
(74) *Attorney, Agent, or Firm*—Matthew L. Madsen; Ying-Horng Liu; Arnold & Porter LLP

(57) ABSTRACT

The present invention is in the field of plant biochemistry. More specifically the invention relates to nucleic acid sequences from plant cells, in particular, DNA sequences from maize and soybean plants associated with the methionine pathway. The invention encompasses nucleic acid molecules that encode proteins and fragments of proteins. In addition, the invention also encompasses proteins and fragments of proteins so encoded and antibodies capable of binding these proteins or fragments. The invention also relates to methods of using the nucleic acid molecules, proteins and fragments of proteins and antibodies, for example for genome mapping, gene identification and analysis, plant breeding, preparation of constructs for use in plant gene expression and transgenic plants.

15 Claims, No Drawings

NUCLEIC ACID MOLECULES ASSOCIATED WITH THE METHIONINE SYNTHESIS AND DEGRADATION PATHWAYS

CROSS REFERENCE TO RELATED APPLICATIONS

This application is a continuation of U.S. application Ser. No. 09/198,779 filed Nov. 24, 1998, now abandoned which claims the benefit under 35 U.S.C. ±119(e) of U.S. Applications No. 60/067,000 filed Nov. 24, 1997, No. 60/066,873 filed Nov. 25, 1997, No. 60/069,472 filed Dec. 9, 1997, No. 60/074,201 filed Feb. 10, 1998, No. 60/074,282 filed Feb. 10, 1998, No. 60/074,280 filed Feb. 10, 1998, No. 60/074,281 filed Feb. 10, 1998, No. 60/074,566 filed Feb. 12, 1998, No. 60/074,567 filed Feb. 12, 1998, No. 60/074,565 filed Feb. 12, 1998, No. 60/075,462 filed Feb. 19, 1998, No. 60/074,789 filed Feb. 19, 1998, No. 60/075,459 filed Feb. 19, 1998, No. 60/075,461 filed Feb. 19, 1998, No. 60/075,464 filed Feb. 19, 1998, No. 60/075,460 filed Feb. 19, 1998, No. 60/075,463 filed Feb. 19, 1998, No. 60/077,231 filed Mar. 9, 1998, No. 60/077,229 filed Mar. 9, 1998, No. 60/077,230 filed Mar. 9, 1998, No. 60/078,031 filed Mar. 16, 1998, No. 60/078,368 filed Mar. 18, 1998, No. 60/080,844 filed Apr. 7, 1998, No. 60/083,067 filed Apr. 27, 1998, No. 60/083,386 filed Apr. 29, 1998, No. 60/083,387 filed Apr. 29, 1998, No. 60/083,388 filed Apr. 29, 1998, No. 60/083,389 filed Apr. 29, 1998, No. 60/084,684 filed May 8, 1998, No. 60/085,245 filed May 13, 1998, No. 60/085,224 filed May 13, 1998, No. 60/085,223 filed May 13, 1998, No. 60/085,222 filed May 13, 1998, No. 60/086,186 filed May 21, 1998, No. 60/086,339 filed May 21, 1998, No. 60/086,187 filed May 21, 1998, No. 60/086,185 filed May 21, 1998, No. 60/086,184 filed May 21, 1998, No. 60/086,183 filed May 21, 1998, No. 60/086,188 filed May 21, 1998, No. 60/089,524 filed Jun. 16, 1998, No. 60/089,810 filed Jun. 18, 1998, No. 60/089,814 filed Jun. 18, 1998, No. 60/091,247 filed Jun. 30, 1998, No. 60/092,036 filed Jul. 8, 1998, No. 60/099,667 filed Sep. 9, 1998, No. 60/099,668 filed Sep. 9, 1998, No. 60/099,670 filed Sep. 9, 1998, No. 60/099,697 filed Sep. 9, 1998, No. 60/100,674 filed Sep. 16, 1998, No. 60/100,673 filed Sep. 16, 1998, No. 60/100,672 filed Sep. 16, 1998, No. 60/101,132 filed Sep. 21, 1998, No. 60/101,130 filed Sep. 21, 1998, No. 60/101,508 filed Sep. 21, 1998, No. 60/101,344 filed Sep. 22, 1998, No. 60/101,347 filed Sep. 22, 1998, No. 60/101,343 filed Sep. 22, 1998, No. 60/104,126 filed Oct. 13, 1998, No. 60/104,128 filed Oct. 13, 1998, No. 60/104,127 filed Oct. 13, 1998, No. 60/104,124 filed Oct. 13, 1998, No. 60/109,018 filed Nov. 18, 1998 and No. 60/108,996 filed Nov. 18, 1998 hereby incorporated by reference herein in their entirety.

Two copies of the sequence listing (Copy 1 and Copy 2) and a computer readable form of the sequence listing, all on CD-ROMs, each filed containing the file named "16517328_seq.txt" which is 1,821,718 bytes in size (measured in MS-DOS) and was created on Oct. 7, 2004, are herein incorporated by reference.

FIELD OF THE INVENTION

The present invention is in the field of plant biochemistry. More specifically the invention relates to nucleic acid sequences from plant cells, in particular, DNA sequences from maize and soybean plants associated with the methionine pathway. The invention encompasses nucleic acid molecules that encode proteins and fragments of proteins. In addition, the invention also encompasses proteins and fragments of proteins so encoded and antibodies capable of binding these proteins or fragments. The invention also relates to methods of using the nucleic acid molecules, proteins and fragments of proteins and antibodies, for example for genome mapping, gene identification and analysis, plant breeding, preparation of constructs for use in plant gene expression and transgenic plants.

BACKGROUND OF THE INVENTION

I. Methoinine Synthesis Pathway

The amino acid, L-methionine, is synthesized in higher plants via a pathway that starts with L-aspartate. This pathway has been studied (Azevedo et al., *Phytochemistry* 46:395-419 (1997), the entirety of which is herein incorporated by reference). L-methionine is one of four so-called aspartate-derived amino acids (along with L-lysine, L-threonine and L-isoleucine) (Miflin et al., In: *Nitrogen Assimilation in Plants*, Hewitt et al., (eds.), Academic Press, New York, 335 (1997); Bryan, In: *The Biochemistry of Plants*, Miflin (ed.), Academic Press, New York, 403 (1980); Lea et al., In: *The Chemistry and Biochemistry of Amino Acids*, Barrett et al., (eds.), London, 5:197 (1985); Bryan, In: *The Biochemistry of Plants*, Miflin et al., (eds.), Academic Press, San Diego, 16:161 (1990), all of which are herein incorporated by reference in their entirety).

The methionine-specific part of the aspartate pathway includes the following enzymes: aspartate kinase (EC 2.7.2.4), aspartate-semialdehyde dehydrogenase (EC 1.2.1.11), homoserine dehydrogenase (EC 1.1.1.3), homoserine kinase (EC 2.7.1.39), cystathionine γ-synthase (EC 4.2.99.9), cystathionine β-lyase (EC 4.4.1.8) and methionine synthase (EC 2.1.1.14).

Aspartate kinase catalyzes the first reaction of the pathway in which aspartate is converted to β-aspartyl phosphate. This enzyme has been isolated and characterized from plant sources including maize, barley, carrot, pea and soybean. These studies have revealed that there are multiple isoenzymes of aspartate kinase and the isoenzymes differ with respect to both feedback inhibition sensitivity and expression profile (tissue and developmental stage). Feedback inhibition is mediated by lysine and threonine. Transgenic plants which express an unregulated aspartate kinase have demonstrated increased flux through the aspartate pathway. Pathway regulation is reported to be exerted, at least in part, via control of this enzyme's activity.

Aspartate semialdehyde dehydrogenase catalyses the second pathway reaction and converts β-aspartyl phosphate to aspartate semialdehyde via an NADPH-dependent reaction. Gengenbach et al., *Crop Science* 18:472-476 (1978), the entirety of which is herein incorporated by reference, report the isolation of aspartate semialdehyde dehydrogenase from maize suspension culture cells. These suspension cultures did not exhibit feedback inhibition of the enzyme in the presence of aspartate-derived amino acids, with the exception of methionine, for which some feedback sensitivity was observed. Aspartate semialdehyde dehydrogenase enzyme activity has been reported in maize shoot, maize root and maize kernel (Gengenbach et al., *Crop Science* 18:472-476 (1978)).

Homoserine dehydrogenase catalyzes the next step of the pathway in which homoserine is generated from aspartate semialdehyde in a reaction requiring NADH or NADPH. Homoserine dehydrogenase enzyme has been studied in higher plants and multiple isoenzyme forms have been reported (Bryan et al., *Biochemistry and Biophysics Research Communications* 41:1211-1217 (1970); Gengenbach et al., Crop Science 18:472-476 (1978); Dotson et al., Plant Physiology 91:1602-1608 (1989); Dotson et al., Plant Physiology 93:98-104 (1989); Azevedo et al., Phytochemistry 31:3725-3730 (1992); Azevedo et al., Phytochemistry 31:3731-3734 (1992); Brennecke et al., Phytochemistry 41:707 (1996); Aarnes, Plant Science Letters 9:137-145 (1977); Bright et al., Biochemical Genetics 200:229-243 (1982); Aruda et al., Plant Physiology 76:442-446 (1984); Lea et al., In: Barley: Genetics, Molecular Biology and Biotechnology Shewrey (ed.), CAB International, Oxford 181 (1992); Davies et al., Plant Science Letters 9:323-332 (1977); Davies et al., Plant Physiology 62:536-541 (1978); Matthews et al., Zeitschrift für Naturforschung, Section Bioscience 34:1177-1185 (1979); Relton et al., Biochimica et Biophysica Acta 953:48-60 (1988); Aarnes et al., Phytochemistry 13:2717-2724 (1974); Lea et al., FEBS Letters 98:165-168 (1979); Matthews et al., Canadian Journal of Botany 57:299-304 (1979), all of which references are incorporated herein in their entirety). The isoenzymes have been found to differ with respect to sensitivity to threonine-mediated feedback inhibition, with both sensitive and insensitive forms being isolated from maize suspension cultures and seedlings (Miflin et al., In: Nitrogen Assimilation of Plants, Hewitt et al., (eds.), Academic Press, New York, 335 (1997); Bryan, In: The Biochemistry of Plants, Miflin (ed.), Academic Press, New York, 5:403 (1980)).

There is evidence that plants also possess a bifunctional enzyme with both aspartate kinase and homoserine dehydrogenase activities (Lea et al., In: The Chemistry and Biochemistry of Amino Acids, Barrett et al. (eds), London, 5:197 (1985), the entirety of which is herein incorporated by reference; Bryan, In: The Biochemistry of Plants, Miflin (ed.), Academic Press, New York, 5:161 (1990), the entirety of which is herein incorporated by reference). Clones of these bifunctional enzymes have been isolated from *Arabidopsis thaliana* (Giovanelli et al., In: The Biochemistry of Plants, Miflin (ed.), Academic Press, New York 453 (1990), the entirety of which is herein incorporated by reference) carrot (Giovanelli et al., Plant Physiology 90:1584-1599 (1989), the entirety of which is herein incorporated by reference), maize (Singh et al., Amino Acids 7:165-168 (1994), the entirety of which is herein incorporated by reference) and soybean (Matthews et al., In: Biosynthesis and Molecular Regulation of Amino Acids in Plants, p 294, Singh et al. (eds.), American Society of Plant Physiologists, Rockville, Md. (1992), the entirety of which is herein incorporated by reference).

The next reported enzymatic step leading to methionine biosynthesis in higher plants is the final common reaction shared by other amino acid end products (threonine and isoleucine). The reaction is catalyzed by homoserine kinase and it generates O-phosphohomoserine from homoserine, with ATP serving as the phosphate donor. Exceptions are *Pisum sativum* and *Lathyrus sitivus* which synthesize O-acetylhomoserine and O-oxalylhomoserine, respectively (Thomas and Surdin-Kerjan, Microbiol. Mol. Biol. Rev. 61:503-532 (1997), the entirety of which is herein incorporated by reference). Enteric bacteria use O-succinylhomoserine, while several gram-positive bacteria, yeasts and fungi use O-acetylhomoserine (formed using homoserine O-acetyltransferase (EC 2.3.1.31) (Thomas and Surdin-Kerjan, Microbiol. Mol. Biol. Rev. 61:503-532 (1997)). Homoserine kinase has been reported from multiple higher plant sources (Galili, The Plant Cell 7:899-906 (1995), the entirety of which is herein incorporated by reference; Rees et al., Biochemical Journal 309:999-1107 (1995), the entirety of which is herein incorporated by reference; Bryan et al., Biochemistry and Biophysics Research Communications 41:1211-1217 (1970), the entirety of which is herein incorporated by reference; Gengenbach et al., Crop Science 18:472-476 (1978), Dotson et al., Plant Physiology 91:1602-1608 (1989), the entirety of which is herein incorporated by reference; Dotson et al., Plant Physiology 93:98-104 (1989), the entirety of which is herein incorporated by reference). Homoserine kinase isolated from barley and wheat has not been reported to exhibit aspartate-derived amino acid feedback inhibition (Gengenbach et al., Crop Science 18:472-476 (1978); Dotson et al., Plant Physiology 93:98-104 (1989)). It has been reported that homoserine kinase exhibits feedback regulation in the dicots, pea (Rees et al., Biochemical Journal 309:999-1007 (1995), the entirety of which is herein incorporated by reference) and radish (Bryan et al., Biochemistry and Biophysics Research Communications 41:1211-1217 (1970)). Bacterial and yeast homologues have been reported (Azevedo et al., Phytochemistry 31:3725-3730 (1992); Azevedo et al., Phytochemistry 31:3731-3734 (1992); Brennecke et al., Phytochemistry 41:707 (1996); Aarnes, Plant Science Letters 9:137-145 (1977)).

Sulfur, in yeast, is incorporated into O-acetylhomoserine resulting in homocysteine. This reaction is catalyzed by the O-acetylhomoserine sulfhydrylase (EC 4.2.99.10) (also known as O-acethomoserine (thiol)-lyase). O-acetylhomoserine sulfhydrylase has been reported to be a homotetramer with a molecular weight of 200,000. O-acetylhomoserine sulfhydrylase has also been reported to bind four molecules of pyridoxal phosphate (Thomas and Surdin-Kerjan, Microbiol. Mol. Biol. Rev. 61:503-532 (1997)).

In higher plants, the sulfur atom from cysteine and the carbon backbone derived from aspartate used to synthesize methionine are reported to be catalyzed by pyridoxal 5'-phosphate (PLP) dependent enzymes (Ravanel et al., Proc. Natl. Acad. Sci. (U.S.A.) 95:7805-7812 (1998), the entirety of which is herein incorporated by reference). The amino acid composition of the O-acetylhomoserine sulfhydrylase has also been reported to share sequence similarities to the *E. coli* cystathionine γ-synthase and cystathionine β-lyase and cystathionine γ-lyase from *Saccharomyces cervisiae* and rats. All of these enzymes thus appear to belong to one protein family, whose members have evolved from an ancestral pyridoxal phosphate enzyme (Thomas and Surdin-Kerjan, Microbiol. Mol. Biol. Rev. 61:503-532 (1997)).

In yeast, the synthesis of cysteine from homocysteine has been reported to require two successive steps, β addition and γ elimination. Cystathionine β-synthase (EC 4.2.1.22) has been reported to catalyze the first reaction where homocysteine and serine yield cystathionine. In *S. cervisiae*, cystathionine β-synthase is encoded by STR4. STR4 encodes a polypeptide of 506 residues which shows extensive sequence similarity to its functional analog in rats. The rat analog has been reported to contain an additional amino-terminal extension of 60 residues. Moreover, the two enzymes have been reported to be closely related to the cysteine synthase from enteric bacteria and plants (Thomas and Surdin-Kerjan, Microbiol. Mol. Biol. Rev. 61:503-532 (1997)).

Cystathionine γ-lyase (EC 4.4.1.1) catalyzes the γ cleavage of cystationine in yeast, the second reported step of the biosynthesis of cysteine from homocysteine. Cystathionine γ-lyase has been reported to have a molecular weight of about 194,000 kd. In *S. cerviseae*, cystathionine γ-lyase is encoded by STR1. A mutation in the *S. cerviseae* cystathionine γ-lyase gene leads to a nutritional requirement for cysteine or glutathione. The yeast cystathionine γ-lyase belongs to a protein family which includes a functional analog in rats, a Met25p from yeast and cystathionin β-lyase and cystathionin γ-synthase from *E. coli* (Thomas and Surdin-Kerjan, *Microbiol. Mol. Biol. Rev.* 61:503-532 (1997)).

Cystathionine γ-synthase (also known as O-succinylhomoserine (thio)-lyase, E.C. 4.2.99.9) catalyzes the first reported reaction which is unique to methionine biosynthesis, thereby committing aspartate pathway flux toward this amino acid. In this reaction, O-phosphohomoserine and cysteine serve as substrates for the production of cystathionine. Cystathionine γ-synthase has not been reported to be regulated by aspartate-derived amino acids feedback inhibition (Bright et al., *Biochemical Genetics* 20:229-243 (1982); Arruda et al., *Plant Physiology* 76:442-446 (1984)). Cystathionine γ-synthase has however, been reported to be sensitive to product inhibition by orthophosphate (Lea et al., *Barley: Genetics, Molecular Biology and Biotechnology*, Shewrey (ed.), CAB International, Oxford, 181 (1992); Davies et al., *Plant Science Letters* 9:323-332 (1977)). Cloned cystathionine γ-synthase have been reported from *Arabidopsis thaliana* (Davies et al., *Plant Physiology* 62:536-541 (1978)). It has been reported that methionine levels are modulated via regulation of cystathionine-synthase (Matthews et al., *Zeitschrift für Naturforschung, Section Bioscience* 34:1177-1185 (1979-2724 (1974); Lea et al., *FEBS Letters* 98:165 (1979), all of which references are incorporated herein in their entirety).

Cystathionine β-lyase catalyzes the next reaction in the biosynthesis of methionine. This reaction generates homocysteine, pyruvate and ammonia from the enzymatic decomposition of cystathionine. Evidence for isoenzymes which differ with respect to cellular localization have been reported for barley (Matthews et al., *Canadian Journal of Botany* 57:299-304 (1979)) and spinach (Rognes et al., *Nature* 287:357-359 (1980), the entirety of which is herein incorporated by reference).

De novo synthesis of methionine from homocysteine uses a methyl group which originates from single-carbon metabolism. In this metabolism, derivatives of tetrahydrofolate transfer one-carbon groups at the oxidation levels of methanol, formaldehyde and formate to acceptor molecules. Single-carbon derivatives of tetrahydrofolate are required for the biosynthesis of methionine, purine nucleotides and thymidylate as well as for the synthesis of N-formylmethionine in the mitochondrion. *S. cerevisiae* possesses two complete sets of folate interconversion enzymes, one located in the cytosol (methionyl-tRNA synthetase, EC 6.1.1.10) and the other located in the mitochondrion (methionyl t-RNA synthetase, EC 6.1.1.10) (Thomas and Surdin-Kerjan, *Microbiol. Mol. Biol. Rev.* 61:503-532 (1997)) and in plants including the chloroplast (Menand et al., *Proc. Natl. Acad. Sci.* (*U.S.A.*), 95:11014-11019 (1998), the entirety of which is herein incorporated by reference).

Methionine synthase generates methionine from homocysteine by a methylation reaction and thus represents the final step of the methionine biosynthetic pathway. Methionine synthase is also sometimes referred to as 5-methyltetrahydropteroyltriglutamate-homocysteine-S-methyltransferase. N-methyltetrahydrofolate serves as the methyl donor in this reaction, which occurs in the absence of cobalamin (Giovanelli et al., *Plant Physiology* 90:1577-1583 (1989), the entirety of which is herein incorporated by reference; Green et al., *Crop Science* 14:827-830 (1974), the entirety of which is herein incorporated by reference).

II. Methoinine Degradation Pathway

Plants contain a pathway for the degradation of L-methionine. This degradation pathway includes the following enzymes: methionine adenosyltransferase (EC 2.5.1.6), methionine S-methyltransferase (EC 2.1.1.12), adenosylmethionine hydrolase (EC 3.3.1.2), homocysteine S-methyltransferase (EC 2.1.1.10) and S-adenosyl-methionine decarboxylase (EC 4.1.1.50).

The reported first step in the catabolism of methionine is the ATP-dependent conversion to S-adenosylmethionine (AdoMet), which is catalyzed by the enzyme methionine adenosyltransferase, also known as S-adenosylmethionine synthetase. Methionine adenosyltransferase enzyme has been characterized from several plant sources (Aarnes, *Plant Science Letters* 10:381 (1977), the entirety of which is herein incorporated by reference; Mathur et al., *Biochimia and Biophysica Acta* 1078:161-170 (1991), the entirety of which is herein incorporated by reference; Kim et al., *Journal of Biochemical and Molecular Biology* 28:100 (1995), the entirety of which is herein incorporated by reference) and nucleic acid molecules (genomic and cDNA) have also been obtained from a variety of sources (Izhaki et al., *Plant Physiology* 108:841-842 (1995), the entirety of which is herein incorporated by reference; Espartero et al., *Molecular Biology Plant* 25:217-237 (1994), the entirety of which is herein incorporated by reference). Regulation of methionine adenosyltransferase activity has been observed for the enzyme from *Glycine max* (soybean). In *Glycine max*, methionine adenosyltransferase was reportedly inhibited by S-adenosylmethionine (Kim et al., *Journal of Biochemical and Molecular Biology* 28:100 (1995). Studies have also reported that the levels of methionine adenosyltransferase appear to fluctuate in response to hormonal or environmental conditions such as gibberellic acid (Mathur et al., *Biochimica and Biophysica Acta* 1162:289-290 (1993), the entirety of which is herein incorporated by reference; Mathur et al., *Biochimica and Biophysica Acta* 1137:338-348 (1992), the entirety of which is herein incorporated by reference), salt stress (Espartero et al., *Molecular Biology Plant* 25:217-227 (1994) the entirety of which is herein incorporated by reference) and wounding (Kim et al., *Plant Cell Reports* 13:340 (1994), the entirety of which is herein incorporated by reference). It has also been reported that methionine adenosyltransferase may play a role in the lignification process (Peleman et al., *Plant Cell* 1:81 (1989), the entirety of which is herein incorporated by reference).

AdoMet is further catabolized by several enzymes and has been reported to serve a variety of metabolic functions including that of a methyl donor (Cossins, *The Biochemistry of Plants* 11:317 Devis (ed.), Academic Press, San Diego (1987), the entirety of which is herein incorporated by reference) that of a precursor for polyamine biosynthesis (Tiburico et al., *The Biochemistry of Plants* 16:283 (1990), the entirety of which is herein incorporated by reference) and that of a precursor for ethylene biosynthesis (Kende, *Plant Physiology* 91:1-4 (1989), the entirety of which is herein incorporated by reference; Flurh et al., *Critical Review of Plant Science* 15:479 (1996), the entirety of which is herein incorporated by reference). In each case, enzymes are present to regenerate methionine from the sulfur-containing backbone resulting in no net loss of methionine.

An enzyme involved in AdoMet catabolism is adenosylmethionine hydrolase (EC 3.3.1.2) which converts AdoMet to methylthioadenosine and L-homoserine. L-homoserine is further metabolized during the biosynthesis of polyamines and ethylene and methylthioadenosine is recycled to methionine. In yeast, a form of adenosylmethioninehydrolase (EC 3.1.1.1) has been reported (on the Worldwide web at ncbi.nlm.nih.gov/htbin-post/Entrez/query (1998)).

Another enzyme for which AdoMet is a substrate for is homocysteine S-methyltransferase. Homocysteine S-methyltransferase catalyzes the combination of AdoMet, with L-homocysteine to produce both S-adenosyl-L-homocysteine and L-methionine. Another enzyme has been described which generates S-adenosyl-L-homocysteine from AdoMet. This enzyme is called methionine S-methyltransferase and it catalyzes the reaction in which S-adenosyl-L-homocysteine reacts with L-methionine to generate S-adenosyl-L-homocysteine and S-methyl-L-methionine. AdoMet can also be decarboxylated by adenosyl methionine decarboxylase, which generates (5-deoxy-5-adenosyl)(3-aminopropyl) methylsulfonium salt.

III. Expressed Sequence Tag Nucleic Acid Molecules

Expressed sequence tags, or ESTs are randomly sequenced members of a cDNA library (or complementary DNA) (McCombie et al., *Nature Genetics* 1:124-130 (1992); Kurata et al., *Nature Genetics* 8:365-372 (1994); Okubo et al., *Nature Genetics* 2:173-179 (1992), all of which references are incorporated herein in their entirety). The randomly selected clones comprise insets that can represent a copy of up to the full length of a mRNA transcript.

Using conventional methodologies, cDNA libraries can be constructed from the mRNA (messenger RNA) of a given tissue or organism using poly dT primers and reverse transcriptase (Efstratiadis et al., *Cell* 7:279-3680 (1976), the entirety of which is herein incorporated by reference; Higuchi et al., *Proc. Natl. Acad. Sci. (U.S.A.)* 73:3146-3150 (1976), the entirety of which is herein incorporated by reference; Maniatis et al., *Cell* 8:163-182 (1976) the entirety of which is herein incorporated by reference; Land et al., *Nucleic Acids Res.* 9:2251-2266 (1981), the entirety of which is herein incorporated by reference; Okayama et al., *Mol. Cell. Biol.* 2:161-170 (1982), the entirety of which is herein incorporated by reference; Gubler et al., *Gene* 25:263-269 (1983), the entirety of which is herein incorporated by reference).

Several methods may be employed to obtain full-length cDNA constructs. For example, terminal transferase can be used to add homopolymeric tails of dC residues to the free 3' hydroxyl groups (Land et al., *Nucleic Acids Res.* 9:2251-2266 (1981), the entirety of which is herein incorporated by reference). This tail can then be hybridized by a poly dG oligo which can act as a primer for the synthesis of full length second strand cDNA. Okayama and Berg, *Mol. Cell. Biol.* 2:161-170 (1982), the entirety of which is herein incorporated by reference, report a method for obtaining full length cDNA constructs. This method has been simplified by using synthetic primer-adapters that have both homopolymeric tails for priming the synthesis of the first and second strands and restriction sites for cloning into plasmids (Coleclough et al., *Gene* 34:305-314 (1985), the entirety of which is herein incorporated by reference) and bacteriophage vectors (Krawinkel et al., *Nucleic Acids Res.* 14:1913 (1986), the entirety of which is herein incorporated by reference; Han et al., *Nucleic Acids Res.* 15:6304 (1987), the entirety of which is herein incorporated by reference).

These strategies have been coupled with additional strategies for isolating rare mRNA populations. For example, a typical mammalian cell contains between 10,000 and 30,000 different mRNA sequences (Davidson, *Gene Activity in Early Development*, 2nd ed., Academic Press, New York (1976), the entirety of which is herein incorporated by reference). The number of clones required to achieve a given probability that a low-abundance mRNA will be present in a cDNA library is $N=(\ln(1-P))/(\ln(1-1/n))$ where N is the number of clones required, P is the probability desired and 1/n is the fractional proportion of the total mRNA that is represented by a single rare mRNA (Sambrook et al., *Molecular Cloning: A Laboratory Manual*, 2nd ed., Cold Spring Harbor Laboratory Press (1989), the entirety of which is herein incorporated by reference).

A method to enrich preparations of mRNA for sequences of interest is to fractionate by size. One such method is to fractionate by electrophoresis through an agarose gel (Pennica et al., *Nature* 301:214-221 (1983), the entirety of which is herein incorporated by reference). Another such method employs sucrose gradient centrifugation in the presence of an agent, such as methylmercuric hydroxide, that denatures secondary structure in RNA (Schweinfest et al., *Proc. Natl. Acad. Sci. (U.S.A.)* 79:4997-5000 (1982), the entirety of which is herein incorporated by reference).

A frequently adopted method is to construct equalized or normalized cDNA libraries (Ko, *Nucleic Acids Res.* 18:5705-5711 (1990), the entirety of which is herein incorporated by reference; Patanjali et al., *Proc. Natl. Acad. Sci. (U.S.A.)* 88:1943-1947 (1991), the entirety of which is herein incorporated by reference). Typically, the cDNA population is normalized by subtractive hybridization (Schmid et al., *J. Neurochem.* 48:307-312 (1987), the entirety of which is herein incorporated by reference; Fargnoli et al., *Anal. Biochem.* 187:364-373 (1990), the entirety of which is herein incorporated by reference; Travis et al., *Proc. Natl. Acad. Sci. (U.S.A.)* 85:1696-1700 (1988), the entirety of which is herein incorporated by reference; Kato, *Eur. J. Neurosci.* 2:704-711 (1990); and Schweinfest et al., *Genet. Anal. Tech. Appl.* 7:64-70 (1990), the entirety of which is herein incorporated by reference). Subtraction represents another method for reducing the population of certain sequences in the cDNA library (Swaroop et al., *Nucleic Acids Res.* 19:1954 (1991), the entirety of which is herein incorporated by reference).

ESTs can be sequenced by a number of methods. Two basic methods may be used for DNA sequencing, the chain termination method of Sanger et al., *Proc. Natl. Acad. Sci. (U.S.A.)* 74:5463-5467 (1977), the entirety of which is herein incorporated by reference and the chemical degradation method of Maxam and Gilbert, *Proc. Nat. Acad. Sci. (U.S.A.)* 74:560-564 (1977), the entirety of which is herein incorporated by reference. Automation and advances in technology such as the replacement of radioisotopes with fluorescence-based sequencing have reduced the effort required to sequence DNA (Craxton, *Methods* 2:20-26 (1991), the entirety of which is herein incorporated by reference; Ju et al., *Proc. Natl. Acad. Sci. (U.S.A.)* 92:4347-4351 (1995), the entirety of which is herein incorporated by reference; Tabor and Richardson, *Proc. Natl. Acad. Sci. (U.S.A.)* 92:6339-6343 (1995), the entirety of which is herein incorporated by reference). Automated sequencers are available from, for example, Pharmacia Biotech, Inc., Piscataway, N.J. (Pharmacia ALF), LI-COR, Inc., Lincoln, Nebr. (LI-COR 4,000) and Millipore, Bedford, Mass. (Millipore BaseStation).

In addition, advances in capillary gel electrophoresis have also reduced the effort required to sequence DNA and such advances provide a rapid high resolution approach for sequencing DNA samples (Swerdlow and Gesteland, *Nucleic Acids Res.* 18:1415-1419 (1990); Smith, *Nature* 349:812-813 (1991); Luckey et al., *Methods Enzymol.* 218:154-172 (1993); Lu et al., *J. Chromatog. A.* 680:497-501 (1994); Carson et al., *Anal. Chem.* 65:3219-3226 (1993); Huang et al., *Anal. Chem.* 64:2149-2154 (1992); Kheterpal et al., *Electrophoresis* 17:1852-1859 (1996); Quesada and Zhang, *Electrophoresis* 17:1841-1851 (1996); Baba, *Yakugaku Zasshi* 117: 265-281 (1997), all of which are herein incorporated by reference in their entirety).

ESTs longer than 150 nucleotides have been found to be useful for similarity searches and mapping (Adams et al., Science 252:1651-1656 (1991), herein incorporated by reference). ESTs, which can represent copies of up to the full length transcript, may be partially or completely sequenced. Between 150-450 nucleotides of sequence information is usually generated as this is the length of sequence information that is routinely and reliably produced using single run sequence data. Typically, only single run sequence data is obtained from the cDNA library (Adams et al., Science 252: 1651-1656 (1991). Automated single run sequencing typically results in an approximately 2-3% error or base ambiguity rate (Boguski et al., Nature Genetics 4:332-333 (1993), the entirety of which is herein incorporated by reference).

EST databases have been constructed or partially constructed from, for example, C. elegans (McCombrie et al., Nature Genetics 1: 124-131 (1992)), human liver cell line HepG2 (Okubo et al., Nature Genetics 2:173-179 (1992)), human brain RNA (Adams et al., Science 252:1651-1656 (1991); Adams et al., Nature 355:632-635 (1992)), Arabidopsis, (Newman et al., Plant Physiol. 106:1241-1255 (1994)); and rice (Kurata et al., Nature Genetics 8:365-372 (1994)).

IV. Sequence Comparisons

A characteristic feature of a DNA sequence is that it can be compared with other DNA sequences. Sequence comparisons can be undertaken by determining the similarity of the test or query sequence with sequences in publicly available or proprietary databases ("similarity analysis") or by searching for certain motifs ("intrinsic sequence analysis") (e.g. cis elements) (Coulson, Trends in Biotechnology 12:76-80 (1994), the entirety of which is herein incorporated by reference); Birren et al., Genome Analysis 1: Cold Spring Harbor Laboratory Press, Cold Spring Harbor, N.Y. 543-559 (1997), the entirety of which is herein incorporated by reference).

Similarity analysis includes database search and alignment. Examples of public databases include the DNA Database of Japan (DDBJ) (on the Worldwide web at ddbj.nig.ac.jp/; GENBANK (on the Worldwide web at ncbi.nlm.nih.gov/Web/SearchlIndex.htlm); and the European Molecular Biology Laboratory Nucleic Acid Sequence Database (EMBL) (on the Worldwide web at ebi.ac.uk/ebi_docs/embl_db/embl_db.html. Other appropriate databases include dbEST (on the Worldwide web at ncbi.nlm.nih.gov/dbEST/index.html, SwissProt (on the Worldwide web at ebi.ac.uk/ebi_docs/swisprot_db/swisshome.html, PIR (on the Worldwide web at nbrt.georgetown.edu/pir/ and The Institute for Genome Research (on the Worldwide web at tigr.org/tdb/tdb.html).

A number of different search algorithms have been developed, one example of which are the suite of programs referred to as BLAST programs. There are five implementations of BLAST, three designed for nucleotide sequences queries (BLASTN, BLASTX and TBLASTX) and two designed for protein sequence queries (BLASTP and TBLASTN) (Coulson, Trends in Biotechnology 12:76-80 (1994); Birren et al., Genome Analysis 1, Cold Spring Harbor Laboratory Press, Cold Spring Harbor, N.Y. 543-559 (1997)).

BLASTN takes a nucleotide sequence (the query sequence) and its reverse complement and searches them against a nucleotide sequence database. BLASTN was designed for speed, not maximum sensitivity and may not find distantly related coding sequences. BLASTX takes a nucleotide sequence, translates it in three forward reading frames and three reverse complement reading frames and then compares the six translations against a protein sequence database. BLASTX is useful for sensitive analysis of preliminary (single-pass) sequence data and is tolerant of sequencing errors (Gish and States, Nature Genetics 3:266-272 (1993), the entirety of which is herein incorporated by reference). BLASTN and BLASTX may be used in concert for analyzing EST data (Coulson, Trends in Biotechnology 12:76-80 (1994); Birren et al., Genome Analysis 1:543-559 (1997)).

Given a coding nucleotide sequence and the protein it encodes, it is often preferable to use the protein as the query sequence to search a database because of the greatly increased sensitivity to detect more subtle relationships. This is due to the larger alphabet of proteins (20 amino acids) compared with the alphabet of nucleic acid sequences (4 bases), where it is far easier to obtain a match by chance. In addition, with nucleotide alignments, only a match (positive score) or a mismatch (negative score) is obtained, but with proteins, the presence of conservative amino acid substitutions can be taken into account. Here, a mismatch may yield a positive score if the non-identical residue has physical/chemical properties similar to the one it replaced. Various scoring matrices are used to supply the substitution scores of all possible amino acid pairs. A general purpose scoring system is the BLOSUM62 matrix (Henikoff and Henikoff, Proteins 17:49-61 (1993), the entirety of which is herein incorporated by reference), which is currently the default choice for BLAST programs. BLOSUM62 is tailored for alignments of moderately diverged sequences and thus may not yield the best results under all conditions. Altschul, J. Mol. Biol. 36:290-300 (1993), the entirety of which is herein incorporated by reference, describes a combination of three matrices to cover all contingencies. This may improve sensitivity, but at the expense of slower searches. In practice, a single BLOSUM62 matrix is often used but others (PAM40 and PAM250) may be attempted when additional analysis is necessary. Low PAM matrices are directed at detecting very strong but localized sequence similarities, whereas high PAM matrices are directed at detecting long but weak alignments between very distantly related sequences.

Homologues in other organisms are available that can be used for comparative sequence analysis. Multiple alignments are performed to study similarities and differences in a group of related sequences. CLUSTAL W is a multiple sequence alignment package that performs progressive multiple sequence alignments based on the method of Feng and Doolittle, J. Mol. Evol. 25:351-360 (1987), the entirety of which is herein incorporated by reference. Each pair of sequences is aligned and the distance between each pair is calculated; from this distance matrix, a guide tree is calculated and all of the sequences are progressively aligned based on this tree. A feature of the program is its sensitivity to the effect of gaps on the alignment; gap penalties are varied to encourage the insertion of gaps in probable loop regions instead of in the middle of structured regions. Users can specify gap penalties, choose between a number of scoring matrices, or supply their own scoring matrix for both pairwise alignments and multiple alignments. CLUSTAL W for UNIX and VMS systems is available at: ftp.ebi.ac.uk. Another program is MACAW (Schuler et al., Proteins Struct. Func. Genet. 9:180-190 (1991), the entirety of which is herein incorporated by reference, for which both Macintosh and Microsoft Windows versions are available. MACAW uses a graphical interface, provides a choice of several alignment algorithms and is available by anonymous ftp at: ncbi.nlm.nih.gov (directory/pub/macaw).

Sequence motifs are derived from multiple alignments and can be used to examine individual sequences or an entire database for subtle patterns. With motifs, it is sometimes possible to detect distant relationships that may not be demonstrable based on comparisons of primary sequences alone. Currently, the largest collection of sequence motifs in the world is PROSITE (Bairoch and Bucher, *Nucleic Acid Research* 22:3583-3589 (1994), the entirety of which is herein incorporated by reference). PROSITE may be accessed via either the ExPASy server on the World Wide Web or anonymous ftp site. Many commercial sequence analysis packages also provide search programs that use PROSITE data.

A resource for searching protein motifs is the BLOCKS E-mail server developed by Henikoff, *Trends Biochem Sci.* 18:267-268 (1993), the entirety of which is herein incorporated by reference; Henikoff and Henikoff, *Nucleic Acid Research* 19:6565-6572 (1991), the entirety of which is herein incorporated by reference; Henikoff and Henikoff, *Proteins* 17:49-61 (1993). BLOCKS searches a protein or nucleotide sequence against a database of protein motifs or "blocks." Blocks are defined as short, ungapped multiple alignments that represent highly conserved protein patterns. The blocks themselves are derived from entries in PROSITE as well as other sources. Either a protein query or a nucleotide query can be submitted to the BLOCKS server; if a nucleotide sequence is submitted, the sequence is translated in all six reading frames and motifs are sought for these conceptual translations. Once the search is completed, the server will return a ranked list of significant matches, along with an alignment of the query sequence to the matched BLOCKS entries.

Conserved protein domains can be represented by two-dimensional matrices, which measure either the frequency or probability of the occurrences of each amino acid residue and deletions or insertions in each position of the domain. This type of model, when used to search against protein databases, is sensitive and usually yields more accurate results than simple motif searches. Two popular implementations of this approach are profile searches such as GCG program ProfileSearch and Hidden Markov Models (HMMs) (Krough et al., *J. Mol. Biol.* 235:1501-1531, (1994); Eddy, *Current Opinion in Structural Biology* 6:361-365, (1996), both of which are herein incorporated by reference in their entirety). In both cases, a large number of common protein domains have been converted into profiles, as present in the PROSITE library, or HHM models, as in the Pfam protein domain library (Sonnhammer et al., *Proteins* 28:405-420 (1997), the entirety of which is herein incorporated by reference). Pfam contains more than 500 HMM models for enzymes, transcription factors, signal transduction molecules and structural proteins. Protein databases can be queried with these profiles or HMM models, which will identify proteins containing the domain of interest. For example, HMMSW or HMMFS, two programs in a public domain package called HMMER (Sonnhammer et al., *Proteins* 28:405-420 (1997)) can be used.

PROSITE and BLOCKS represent collected families of protein motifs. Thus, searching these databases entails submitting a single sequence to determine whether or not that sequence is similar to the members of an established family. Programs working in the opposite direction compare a collection of sequences with individual entries in the protein databases. An example of such a program is the Motif Search Tool, or MoST (Tatusov et al., *Proc. Natl. Acad. Sci. (U.S.A.)* 91:12091-12095 (1994), the entirety of which is herein incorporated by reference). On the basis of an aligned set of input sequences, a weight matrix is calculated by using one of four methods (selected by the user). A weight matrix is simply a representation, position by position of how likely a particular amino acid will appear. The calculated weight matrix is then used to search the databases. To increase sensitivity, newly found sequences are added to the original data set, the weight matrix is recalculated and the search is performed again. This procedure continues until no new sequences are found.

SUMMARY OF THE INVENTION

The present invention provides a substantially purified nucleic acid molecule that encodes a maize or soybean enzyme or fragment thereof, wherein said maize or soybean enzyme is selected from the group consisting of: (a) methionine adenosyltransferase, (b) S-adenosyl-methionine decarboxylase, (c) aspartate kinase, (d) aspartate-semialdehyde dehydrogenase, (e) cystathionine gamma-synthase, (f) cystathionine beta-lysase, and (g) 5-methyltetrahydropteroyltriglutamate-homocysteine-S-methyltransferase.

The present invention also provides a substantially purified nucleic acid molecule that encodes a plant methionine pathway enzyme or fragment thereof, wherein the nucleic acid molecule is selected from the group consisting of a nucleic acid molecule that encodes a maize or a soybean methionine adenosyltransferase enzyme or fragment thereof, a nucleic acid molecule that encodes a maize or a soybean S-adenosylmethionine decarboxylase enzyme or fragment thereof, a nucleic acid molecule that encodes a maize or a soybean aspartate kinase enzyme or fragment thereof, a nucleic acid molecule that encodes a maize or a soybean aspartate-semialdehyde dehydrogenase enzyme or fragment thereof, a nucleic acid molecule that encodes a maize or a soybean O-succinylhomoserine (thiol)-lyase enzyme or fragment thereof, a nucleic acid molecule that encodes a maize or a soybean cystathionine β-lyase enzyme or fragment thereof, a nucleic acid molecule that encodes a maize or a soybean 5-methyltetrahydropteroyltriglutamate-homocysteine-S-methyltransferase enzyme or fragment thereof, a nucleic acid molecule that encodes a maize or a soybean adenosylhomocysteinase enzyme or fragment thereof, a nucleic acid molecule that encodes a maize or a soybean cystathionine β-synthase enzyme or fragment thereof, a nucleic acid molecule that encodes a maize or a soybean cystathionine γ-lyase enzyme or fragment thereof and a nucleic acid molecule that encodes a maize or a soybean O-acetylhomoserine (thiol)-lyase enzyme or fragment thereof.

A substantially purified maize or soybean enzyme or fragment thereof, wherein said maize or soybean enzyme is selected from the group consisting of (a) methionine adenosyltransferase or fragment thereof; (b) S-adenosyl-methionine decarboxylase or fragment thereof; (c) aspartate kinase or fragment thereof; (d) aspartate-semialdehyde dehydrogenase or fragment thereof; (e) cystathionine gamma-synthase or fragment thereof; (f) cystathionine beta-lysase or fragment thereof; and (e) 5-methyltetrahydropteroyltriglutamate-homocysteine-S-methyltransferase or fragment thereof.

The present invention also provides a substantially purified maize or soybean methionine pathway protein or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1 through SEQ ID NO: 3204.

The present invention also provides a substantially purified maize or soybean methionine adenosyltransferase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1 through SEQ ID NO: 429 and SEQ ID NO: 1635 through SEQ ID NO: 2479.

The present invention also provides a substantially purified maize or soybean methionine adenosyltransferase enzyme or fragment thereof encoded by a nucleic acid sequence selected from the group consisting of SEQ ID NO: 1 through SEQ ID NO: 429 and SEQ ID NO: 1635 through SEQ ID NO: 2479.

The present invention also provides a substantially purified maize or soybean S-adenosylmethionine decarboxylase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 430 through SEQ ID NO: 857 and SEQ ID NO: 2480 through SEQ ID NO: 2623.

The present invention also provides a substantially purified maize or soybean S-adenosylmethionine decarboxylase enzyme or fragment thereof encoded by a nucleic acid sequence selected from the group consisting of SEQ ID NO: 430 through SEQ ID NO: 857 and SEQ ID NO: 2480 through SEQ ID NO: 2623.

The present invention also provides a substantially purified maize or soybean aspartate kinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 858 through SEQ ID NO: 900 and SEQ ID NO: 2624 through SEQ ID NO: 2648.

The present invention also provides a substantially purified maize or soybean aspartate kinase enzyme or fragment thereof encoded by a nucleic acid sequence selected from the group consisting of SEQ ID NO: 858 through SEQ ID NO: 900 and SEQ ID NO: 2624 through SEQ ID NO: 2648.

The present invention also provides a substantially purified maize or soybean aspartate-semialdehyde dehydrogenase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 901 through SEQ ID NO: 904 and SEQ ID NO: 2649 through SEQ ID NO: 2654.

The present invention also provides a substantially purified maize or soybean aspartate-semialdehyde dehydrogenase enzyme or fragment thereof encoded by a nucleic acid sequence selected from the group consisting of SEQ ID NO: 901 through SEQ ID NO: 904 and SEQ ID NO: 2649 through SEQ ID NO: 2654.

The present invention also provides a substantially purified maize or soybean O-succinylhomoserine (thiol)-lyase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 905 through SEQ ID NO: 953 and SEQ ID NO: 2655 through SEQ ID NO: 2660.

The present invention also provides a substantially purified maize or soybean O-succinylhomoserine (thiol)-lyase enzyme or fragment thereof encoded by a nucleic acid sequence selected from the group consisting of SEQ ID NO: 905 through SEQ ID NO: 953 and SEQ ID NO: 2655 through SEQ ID NO: 2660.

The present invention also provides a substantially purified maize or soybean cystathionine β-lyase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 954 through SEQ ID NO: 963 and SEQ ID NO: 2661 through SEQ ID NO: 2665.

The present invention also provides a substantially purified maize or soybean cystathionine β-lyase enzyme or fragment thereof encoded by a nucleic acid sequence selected from the group consisting of SEQ ID NO: 954 through SEQ ID NO: 963 and SEQ ID NO: 2661 through SEQ ID NO: 2665.

The present invention also provides a substantially purified maize or soybean 5-methyltetrahydropteroyltriglutamate-homocysteine-S-methyltransferase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 964 through SEQ ID NO: 1353 and SEQ ID NO: 2666 through SEQ ID NO: 2992.

The present invention also provides a substantially purified maize or soybean 5-methyltetrahydropteroyltriglutamate-homocysteine-S-methyltransferase enzyme or fragment thereof encoded by a nucleic acid sequence selected from the group consisting of SEQ ID NO: 964 through SEQ ID NO: 1353 and SEQ ID NO: 2666 through SEQ ID NO: 2992.

The present invention also provides a substantially purified maize or adenosylhomocysteinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1354 through SEQ ID NO: 1630 and SEQ ID NO: 2993 through SEQ ID NO: 3199.

The present invention also provides a substantially purified maize or adenosylhomocysteinase enzyme or fragment thereof encoded by a nucleic acid sequence selected from the group consisting of SEQ ID NO: 1354 through SEQ ID NO: 1630 and SEQ ID NO: 2993 through SEQ ID NO: 3199.

The present invention also provides a substantially purified maize or cystathionine β-synthase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1631 through SEQ ID NO: 1632.

The present invention also provides a substantially purified maize or cystathionine β-synthase enzyme or fragment thereof encoded by a nucleic acid sequence selected from the group consisting of SEQ ID NO: 1631 through SEQ ID NO: 1632.

The present invention also provides a substantially purified maize or cystathionine γ-lyase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1633 through SEQ ID NO: 1634 and SEQ ID NO: 3203 through SEQ ID NO: 3204.

The present invention also provides a substantially purified maize or cystathionine γ-lyase enzyme or fragment thereof encoded by a nucleic acid sequence selected from the group consisting of SEQ ID NO: 1633 through SEQ ID NO: 1634 and SEQ ID NO: 3203 through SEQ ID NO: 3204.

The present invention also provides a substantially purified maize or O-acetylhomoserine (thiol)-lyase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 3200 through SEQ ID NO: 3202.

The present invention also provides a substantially purified maize or O-acetylhomoserine (thiol)-lyase enzyme or fragment thereof encoded by a nucleic acid sequence selected from the group consisting of SEQ ID NO: 3200 through SEQ ID NO: 3202.

The present invention also provides a purified antibody or fragment thereof which is capable of specifically binding to a specific maize or soybean enzyme or fragment thereof, wherein said maize or soybean enzyme or fragment thereof is encoded by a nucleic acid molecule comprising a nucleic acid sequence selected from the group consisting of consisting of SEQ ID NO: 1 through SEQ ID NO: 3204.

The present invention also provides a substantially purified antibody or fragment thereof, the antibody or fragment thereof capable of specifically binding to a maize or a soybean methionine adenosyltransferase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1 through SEQ ID NO: 429 and SEQ. ID NO: 1635 through SEQ ID NO: 2479 or a substantially purified maize or soybean methionine adenosyltransferase enzyme or fragment thereof encoded by a nucleic acid sequence selected from the group consisting of SEQ ID NO: 1 through SEQ ID NO: 429 and SEQ ID NO: 1635 through SEQ ID NO: 2479.

The present invention also provides a substantially purified antibody or fragment thereof, the antibody or fragment thereof capable of specifically binding to a maize or a soybean S-adenosylmethionine decarboxylase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 430 through SEQ ID NO: 857 and SEQ ID NO: 2480 through SEQ ID NO: 2623 or a substantially purified maize or soybean S-adenosylmethionine decarboxylase enzyme or fragment thereof encoded by a nucleic acid sequence selected from the group consisting of SEQ ID NO: 430 through SEQ ID NO: 857 and SEQ ID NO: 2480 through SEQ ID NO: 2623.

The present invention also provides a substantially purified antibody or fragment thereof, the antibody or fragment thereof capable of specifically binding to a maize or a soybean aspartate kinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 858 through SEQ ID NO: 900 and SEQ ID NO: 2624 through SEQ ID NO: 2648 or a substantially purified maize or soybean aspartate kinase enzyme or fragment thereof encoded by a nucleic acid sequence selected from the group consisting of SEQ ID NO: 858 through SEQ ID NO: 900 and SEQ ID NO: 2624 through SEQ ID NO: 2648.

The present invention also provides a substantially purified antibody or fragment thereof, the antibody or fragment thereof capable of specifically binding to a maize or a soybean aspartate-semialdehyde dehydrogenase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 901 through SEQ ID NO: 904 and SEQ ID NO: 2649 through SEQ ID NO: 2654 or a substantially purified maize or soybean enzyme aspartate-semialdehyde dehydrogenase or fragment thereof encoded by a nucleic acid sequence selected from the group consisting of SEQ ID NO: 901 through SEQ ID NO: 904 and SEQ ID NO: 2649 through SEQ ID NO: 2654.

The present invention also provides a substantially purified antibody or fragment thereof, the antibody or fragment thereof capable of specifically binding to a maize or a soybean O-succinylhomoserine (thiol)-lyase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 905 through SEQ ID NO: 953 and SEQ ID NO: 2655 through SEQ ID NO: 2660 or a substantially purified maize or soybean O-succinylhomoserine (thiol)-lyase enzyme or fragment thereof encoded by a nucleic acid sequence selected from the group consisting of SEQ ID NO: 905 through SEQ ID NO: 953 and SEQ ID NO: 2655 through SEQ ID NO: 2660.

The present invention also provides a substantially purified antibody or fragment thereof, the antibody or fragment thereof capable of specifically binding to a maize or a soybean cystathionine β-lyase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 954 through SEQ ID NO: 963 and SEQ ID NO: 2661 through SEQ ID NO: 2665 or a substantially purified maize or soybean cystathionine β-lyase enzyme or fragment thereof encoded by a nucleic acid sequence selected from the group consisting of SEQ ID NO: 954 through SEQ ID NO: 963 and SEQ ID NO: 2661 through SEQ ID NO: 2665.

The present invention also provides a substantially purified antibody or fragment thereof, the antibody or fragment thereof capable of specifically binding to a maize or a soybean 5-methyltetrahydropteroyltriglutamate-homocysteine-S-methyltransferase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 964 through SEQ ID NO: 1353 and SEQ ID NO: 2666 through SEQ ID NO: 2992 or a substantially purified maize or soybean 5-methyltetrahydropteroyltriglutamate-homocysteine-S-methyltransferase enzyme or fragment thereof encoded by a nucleic acid sequence selected from the group consisting of SEQ ID NO: 964 through SEQ ID NO: 1353 and SEQ ID NO: 2666 through SEQ ID NO: 2992.

The present invention also provides a substantially purified antibody or fragment thereof, the antibody or fragment thereof capable of specifically binding to a maize or a soybean adenosylhomocyteinase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1354 through SEQ ID NO: 1630 and SEQ ID NO: 2993 through SEQ ID NO: 3199 or a substantially purified maize or soybean adenosylhomocyteinase enzyme or fragment thereof encoded by a nucleic acid sequence selected from the group consisting of SEQ ID NO: 1354 through SEQ ID NO: 1630 and SEQ ID NO: 2993 through SEQ ID NO: 3199.

The present invention also provides a substantially purified antibody or fragment thereof, the antibody or fragment thereof capable of specifically binding to a maize or a soybean cystathionine β-synthase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1631 through SEQ ID NO: 1632 or a substantially purified maize or soybean cystathionine β-synthase enzyme or fragment thereof encoded by a nucleic acid sequence selected from the group consisting of SEQ ID NO: 1631 through SEQ ID NO: 1632.

The present invention also provides a substantially purified antibody or fragment thereof, the antibody or fragment thereof capable of specifically binding to a maize or a soybean cystathionine γ-lyase enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 1633 through SEQ ID NO: 1634 and SEQ ID NO: 3203 through SEQ ID NO: 3204 or a substantially purified maize or soybean cystathionine γ-lyase enzyme or fragment thereof encoded by a nucleic acid sequence selected from the group consisting of SEQ ID NO: 1633 through SEQ ID NO: 1634 and SEQ ID NO: 3203 through SEQ ID NO: 3204.

The present invention also provides a substantially purified antibody or fragment thereof, the antibody or fragment thereof capable of specifically binding to a maize or a soybean O-acetylhomoserine enzyme or fragment thereof encoded by a first nucleic acid molecule which specifically hybridizes to a second nucleic acid molecule, the second nucleic acid molecule having a nucleic acid sequence selected from the group consisting of a complement of SEQ ID NO: 3200 through SEQ ID NO: 3202 or a substantially purified maize or soybean O-acetylhomoserine enzyme or fragment thereof encoded by a nucleic acid sequence selected from the group consisting of SEQ ID NO: 3200 through SEQ ID NO: 3202.

The present invention also provides a transformed plant having a nucleic acid molecule which comprises: (A) an exogenous promoter region which functions in a plant cell to cause the production of a mRNA molecule; (B) a structural nucleic acid molecule comprising a nucleic acid sequence selected from the group consisting of (a) a nucleic acid sequence which encodes for methionine adenosyltransferase or fragment thereof, (b) a nucleic acid sequence which encodes for S-adenosyl-methionine decarboxylase or fragment thereof, (c) a nucleic acid sequence which encodes for aspartate kinase or fragment thereof; (d) a nucleic acid sequence which encodes for aspartate-semialdehyde dehydrogenase or fragment thereof; (e) a nucleic acid sequence which encodes for cystathionine gamma-synthase or a fragment thereof; (f) a nucleic acid sequence which encodes for cystathionine beta-lysase or a fragment thereof; (g) a nucleic acid sequence which encodes for 5-methyltetrahydropteroyl-triglutamate-homocysteine-S-methyltransferase or a fragment thereof; and (h) a nucleic acid sequence which is complementary to any of the nucleic acid sequences of (a) through (g); and (C) a 3' non-translated sequence that functions in said plant cell to cause termination of transcription and addition of polyadenylated ribonucleotides to a 3' end of said mRNA molecule.

The present invention also provides a transformed plant having a nucleic acid molecule which comprises: (A) an exogenous promoter region which functions in a plant cell to cause the production of a mRNA molecule; which is linked to (B) a structural nucleic acid molecule, wherein the structural nucleic acid molecule encodes a plant methionine pathway enzyme or fragment thereof, the structural nucleic acid molecule comprising a nucleic acid sequence selected from the group consisting of SEQ ID NO: 1 through SEQ ID NO: 3204 or fragment thereof; which is linked to (C) a 3' non-translated sequence that functions in the plant cell to cause termination of transcription and addition of polyadenylated ribonucleotides to a 3' end of the mRNA molecule.

The present invention also provides a transformed plant having a nucleic acid molecule which comprises: (A) an exogenous promoter region which functions in a plant cell to cause the production of a mRNA molecule; which is linked to (B) a structural nucleic acid molecule, wherein the structural nucleic acid molecule is selected from the group consisting of a nucleic acid molecule that encodes a maize or a soybean methionine adenosyltransferase enzyme or fragment thereof, a nucleic acid molecule that encodes a maize or a soybean S-adenosylmethionine decarboxylase enzyme or fragment thereof, a nucleic acid molecule that encodes a maize or soybean aspartate kinase enzyme or fragment thereof, a nucleic acid molecule that encodes a maize or a soybean aspartate-semialdehyde dehydrogenase enzyme or fragment thereof, a nucleic acid molecule that encodes a maize or a soybean O-succinylhomoserine (thiol)-lyase enzyme or fragment thereof, a nucleic acid molecule that encodes a maize or a soybean cystathionine β-lyase enzyme or fragment thereof, a nucleic acid molecule that encodes a maize or a soybean 5-methyltetrahydropteroyltriglutamate-homocysteine-S-methyltransferase enzyme or fragment thereof, a nucleic acid molecule that encodes a maize or a soybean adenosylhomocysteinase enzyme or fragment thereof, a nucleic acid molecule that encodes a maize or a soybean cystathionine β-synthase enzyme or fragment thereof, a nucleic acid molecule that encodes a maize or a soybean cystathionine γ-lyase enzyme or fragment thereof and a nucleic acid molecule that encodes a maize or a soybean O-acetylhomoserine (thiol)-lyase enzyme or fragment thereof; which is linked to (C) a 3' non-translated sequence that functions in the plant cell to cause termination of transcription and addition of polyadenylated ribonucleotides to a 3' end of the mRNA molecule.

The present invention also provides a transformed plant having a nucleic acid molecule which comprises: (A) an exogenous promoter region which functions in a plant cell to cause the production of a mRNA molecule; which is linked to (B) a transcribed nucleic acid molecule with a transcribed strand and a non-transcribed strand, wherein the transcribed strand is complementary to a nucleic acid molecule comprising a nucleic acid sequence selected from the group consisting of SEQ ID NO: 1 through SEQ ID NO: 3204 or fragment thereof; which is linked to (C) a 3' non-translated sequence that functions in plant cells to cause termination of transcription and addition of polyadenylated ribonucleotides to a 3' end of the mRNA molecule.

The present invention also provides a transformed plant having a nucleic acid molecule which comprises: (A) an exogenous promoter region which functions in a plant cell to cause the production of a mRNA molecule; which is linked to: (B) a transcribed nucleic acid molecule with a transcribed strand and a non-transcribed strand, wherein a transcribed mRNA of the transcribed strand is complementary to an endogenous mRNA molecule having a nucleic acid sequence selected from the group consisting of an endogenous mRNA molecule that encodes a maize or a soybean methionine adenosyltransferase enzyme or fragment thereof, an endogenous mRNA molecule that encodes a maize or a soybean S-adenosylmethionine decarboxylase enzyme or fragment thereof, an endogenous mRNA molecule that encodes a maize or a soybean aspartate kinase enzyme or fragment thereof, an endogenous mRNA molecule that encodes a maize or a soybean aspartate-semialdehyde dehydrogenase enzyme or fragment thereof, an endogenous mRNA molecule that encodes a maize or a soybean O-succinylhomoserine (thiol)-lyase enzyme or fragment thereof, an endogenous mRNA molecule that encodes a maize or a soybean cystathionine β-lyase enzyme or fragment thereof, an endogenous mRNA molecule that encodes a maize or a soybean 5-methyltetrahydropteroyltriglutamate-homocysteine-S-methyltransferase enzyme or fragment thereof, an endogenous mRNA molecule that encodes a maize or a soybean adenosylhomocysteinase enzyme or fragment thereof, an endogenous mRNA molecule that encodes a maize or a soybean cystathionine β-synthase enzyme or fragment thereof, an endogenous mRNA molecule that encodes a maize or a soybean cystathionine γ-lyase enzyme or fragment thereof and an endogenous mRNA molecule that encodes a maize or a soybean O-acetylhomoserine (thiol)-lyase enzyme or fragment thereof; which is linked to (C) a 3' non-translated sequence that functions in the plant cell to cause termination of transcription and addition of polyadenylated ribonucleotides to a 3' end of the mRNA molecule.

The present invention also provides a method for determining a level or pattern in a plant cell of an enzyme in a plant metabolic pathway comprising: (A) incubating, under conditions permitting nucleic acid hybridization, a marker nucleic acid molecule, said marker nucleic acid molecule selected from the group of marker nucleic acid molecules which specifically hybridize to a nucleic acid molecule having the nucleic acid sequence of SEQ ID NO: 1 through SEQ ID NO: 3204 or compliments thereof, with a complementary nucleic acid molecule obtained from said plant cell or plant tissue, wherein nucleic acid hybridization between said marker nucleic acid molecule and said complementary nucleic acid molecule obtained from said plant cell or plant tissue permits the detection of an mRNA for said enzyme; (B) permitting hybridization between said marker nucleic acid molecule and said complementary nucleic acid molecule obtained from said plant cell or plant tissue; and (C) detecting the level or pattern of said complementary nucleic acid, wherein the detection of said complementary nucleic acid is predictive of the level or pattern of said enzyme in said plant metabolic pathway.

The present invention also provides a method for determining a level or pattern of a plant methionine pathway enzyme in a plant cell or plant tissue comprising: (A) incubating, under conditions permitting nucleic acid hybridization, a marker nucleic acid molecule, the marker nucleic acid molecule having a nucleic acid sequence selected from the group consisting of SEQ ID NO: 1 through SEQ ID NO: 3204 or complement thereof or fragment of either, with a complementary nucleic acid molecule obtained from the plant cell or plant tissue, wherein nucleic acid hybridization between the marker nucleic acid molecule and the complementary nucleic acid molecule obtained from the plant cell or plant tissue permits the detection of the plant methionine pathway enzyme; (B) permitting hybridization between the marker nucleic acid molecule and the complementary nucleic acid molecule obtained from the plant cell or plant tissue; and (C) detecting the level or pattern of the complementary nucleic acid, wherein the detection of the complementary nucleic acid is predictive of the level or pattern of the plant methionine pathway enzyme.

The present invention also provides a method for determining a level or pattern of a plant methionine pathway enzyme in a plant cell or plant tissue comprising: (A) incubating, under conditions permitting nucleic acid hybridization, a marker nucleic acid molecule, the marker nucleic acid molecule comprising a nucleic acid molecule that encodes a maize or a soybean methionine adenosyltransferase enzyme or complement thereof or fragment of either, a nucleic acid molecule that encodes a maize or a soybean S-adenosylmethionine decarboxylase enzyme or complement thereof or fragment of either, a nucleic acid molecule that encodes a maize or a soybean aspartate kinase enzyme or complement thereof or fragment of either, a nucleic acid molecule that encodes a maize or a soybean aspartate-semialdehyde dehydrogenase enzyme or complement thereof or fragment of either, a nucleic acid molecule that encodes a maize or a soybean O-succinylhomoserine (thiol)-lyase enzyme or complement thereof or fragment of either, a nucleic acid molecule that encodes a maize or a soybean cystathionine β-lyase enzyme or complement thereof or fragment of either, a nucleic acid molecule that encodes a maize or a soybean 5-methyltetrahydropteroyltriglutamate-homocysteine-S-methyltransferase enzyme or complement thereof or fragment of either, a nucleic acid molecule that encodes a maize or a soybean adenosylhomocysteinase enzyme or complement thereof or fragment of either, a nucleic acid molecule that encodes a maize or a soybean cystathionine β-synthase enzyme or complement thereof or fragment of either, a nucleic acid molecule that encodes a maize or a soybean cytsathionine γ-lyase enzyme or complement thereof or fragment of either and a nucleic acid molecule that encodes a maize or a soybean O-acetylhomoserine (thiol)-lyase enzyme or complement thereof or fragment of either, with a complementary nucleic acid molecule obtained from the plant cell or plant tissue, wherein nucleic acid hybridization between the marker nucleic acid molecule and the complementary nucleic acid molecule obtained from the plant cell or plant tissue permits the detection of the plant methionine pathway enzyme; (B) permitting hybridization between the marker nucleic acid molecule and the complementary nucleic acid molecule obtained from the plant cell or plant tissue; and (C) detecting the level or pattern of the complementary nucleic acid, wherein the detection of the complementary nucleic acid is predictive of the level or pattern of the plant methionine pathway enzyme.

The present invention also provides a method for determining a level or pattern of a plant methionine pathway enzyme in a plant cell or plant tissue under evaluation which comprises assaying the concentration of a molecule, whose concentration is dependent upon the expression of a gene, the gene specifically hybridizes to a nucleic acid molecule having a nucleic acid sequence selected from the group consisting of SEQ ID NO: 1 through SEQ ID NO: 3204 or complements thereof, in comparison to the concentration of that molecule present in a reference plant cell or a reference plant tissue with a known level or pattern of the plant methionine pathway enzyme, wherein the assayed concentration of the molecule is compared to the assayed concentration of the molecule in the reference plant cell or reference plant tissue with the known level or pattern of the plant methionine pathway enzyme.

The present invention also provides a method for determining a level or pattern of a plant methionine pathway enzyme in a plant cell or plant tissue under evaluation which comprises assaying the concentration of a molecule, whose concentration is dependent upon the expression of a gene, the gene specifically hybridizes to a nucleic acid molecule selected from the group consisting of a nucleic acid molecule that encodes a maize or a soybean methionine adenosyltransferase enzyme or complement thereof, a nucleic acid molecule that encodes a maize or a soybean S-adenosylmethionine decarboxylase enzyme or complement thereof, a nucleic acid molecule that encodes a maize or a soybean aspartate kinase enzyme or complement thereof, a nucleic acid molecule that encodes a maize or a soybean aspartate-semialdehyde dehydrogenase enzyme or complement thereof, a nucleic acid molecule that encodes a maize or a soybean O-succinylhomoserine (thiol)-lyase enzyme or complement thereof, a nucleic acid molecule that encodes a maize or a soybean cystathionine β-lyase enzyme or complement thereof, a nucleic acid molecule that encodes a maize or a soybean 5-methyltetrahydropteroyltriglutamate-homocysteine-S-methyltransferase enzyme or complement thereof, a nucleic acid molecule that encodes a maize or a soybean adenosylhomocyteinase enzyme or complement thereof, a nucleic acid molecule that encodes a maize or a soybean cystathionine β-synthase enzyme or complement thereof, a nucleic acid molecule that encodes a maize or a soybean cystathionine γ-lyase enzyme or complement thereof and a nucleic acid molecule that encodes a maize or a soybean O-acetylhomoserine (thiol)-lyase enzyme or complement thereof, in comparison to the concentration of that molecule present in a reference plant cell or a reference plant tissue with a known level or pattern of the plant methionine pathway enzyme, wherein the assayed concentration of the molecule is compared to the assayed concentration of the molecule in the reference plant cell or the reference plant tissue with the known level or pattern of the plant methionine pathway enzyme.

A method of determining a mutation in a plant whose presence is predictive of a mutation affecting a level or pattern of a protein comprising the steps: (A) incubating, under conditions permitting nucleic acid hybridization, a marker nucleic acid, said marker nucleic acid selected from the group of marker nucleic acid molecules which specifically hybridize to a nucleic acid molecule having a nucleic acid sequence selected from the group of SEQ ID NO: 1 through SEQ ID NO: 3204 or complements thereof and a complementary nucleic acid molecule obtained from said plant, wherein nucleic acid hybridization between said marker nucleic acid molecule and said complementary nucleic acid molecule obtained from said plant permits the detection of a polymorphism whose presence is predictive of a mutation affecting said level or pattern of said plant methionine pathway enzyme in said plant; (B) permitting hybridization between said marker nucleic acid molecule and said complementary nucleic acid molecule obtained from said plant; and (C) detecting the presence of said polymorphism, wherein the detection of said polymorphism is predictive of said mutation.

The present invention also provides a method for determining a mutation in a plant whose presence is predictive of a mutation affecting the level or pattern of a plant methionine pathway enzyme comprising the steps: (A) incubating, under conditions permitting nucleic acid hybridization, a marker nucleic acid molecule, the marker nucleic acid molecule comprising a nucleic acid molecule that is linked to a gene, the gene specifically hybridizes to a nucleic acid molecule having a nucleic acid sequence selected from the group consisting of SEQ ID NO: 1 through SEQ ID NO: 3204 or complements thereof and a complementary nucleic acid molecule obtained from the plant, wherein nucleic acid hybridization between the marker nucleic acid molecule and the complementary nucleic acid molecule obtained from the plant permits the detection of a polymorphism whose presence is predictive of a mutation affecting the level or pattern of the plant methionine pathway enzyme in the plant; (B) permitting hybridization between the marker nucleic acid molecule and the complementary nucleic acid molecule obtained from the plant; and (C) detecting the presence of the polymorphism, wherein the detection of the polymorphism is predictive of the mutation.

The present invention also provides a method for determining a mutation in a plant whose presence is predictive of a mutation affecting the level or pattern of a plant methionine pathway enzyme comprising the steps: (A) incubating, under conditions permitting nucleic acid hybridization, a marker nucleic acid molecule, the marker nucleic acid molecule comprising a nucleic acid molecule that is linked to a gene, the gene specifically hybridizes to a nucleic acid molecule selected from the group consisting of a nucleic acid molecule that encodes a maize or a soybean methionine adenosyltransferase enzyme or complement thereof, a nucleic acid molecule that encodes a maize or a soybean S-adenosylmethionine decarboxylase enzyme or complement thereof, a nucleic acid molecule that encodes a maize or a soybean aspartate kinase enzyme or complement thereof, a nucleic acid molecule that encodes a maize or a soybean aspartate-semialdehyde dehydrogenase enzyme or complement thereof, a nucleic acid molecule that encodes a maize or a soybean O-succinylhomoserine (thiol)-lyase enzyme or complement thereof, a nucleic acid molecule that encodes a maize or a soybean cystathionine β-lyase enzyme or complement thereof, a nucleic acid molecule that encodes a maize or a soybean 5-methyltetrahydropteroyltriglutamate-homocysteine-S-methyltransferase enzyme or complement thereof, a nucleic acid molecule that encodes a maize or a soybean adenosylhomocyteinase enzyme or complement thereof, a nucleic acid molecule that encodes a maize or a soybean cystathionine β-synthase enzyme or complement thereof, a nucleic acid molecule that encodes a maize or a soybean cystathionine γ-lyase enzyme or complement thereof and a nucleic acid molecule that encodes a maize or a soybean O-acetylhomoserine (thiol)-lyase enzyme or complement thereof and a complementary nucleic acid molecule obtained from the plant, wherein nucleic acid hybridization between the marker nucleic acid molecule and the complementary nucleic acid molecule obtained from the plant permits the detection of a polymorphism whose presence is predictive of a mutation affecting the level or pattern of the plant methionine pathway enzyme in the plant; (B) permitting hybridization between the marker nucleic acid molecule and the complementary nucleic acid molecule obtained from the plant; and (C) detecting the presence of the polymorphism, wherein the detection of the polymorphism is predictive of the mutation.

A method of producing a plant containing an overexpressed protein comprising: (A) transforming said plant with a functional nucleic acid molecule, wherein the functional nucleic acid molecule comprises a promoter region, wherein said promoter region is linked to a structural region, wherein said structural region has a nucleic acid sequence selected from group consisting of SEQ ID NO: 1 through SEQ ID NO: 3204 wherein said structural region is linked to a 3' non-translated sequence that functions in the plant to cause termination of transcription and addition of polyadenylated ribonucleotides to a 3' end of a mRNA molecule; and wherein said functional nucleic acid molecule results in overexpression of the protein; and (B) growing said transformed plant.

The present invention also provides a method of producing a plant containing an overexpressed plant methionine enzyme comprising: (A) transforming the plant with a functional nucleic acid molecule, wherein the functional nucleic acid molecule comprises a promoter region, wherein the promoter region is linked to a structural region, wherein the structural region comprises a nucleic acid molecule having a nucleic acid sequence selected from the group consisting of SEQ ID NO: 1 through SEQ ID NO: 3204 or fragment thereof; wherein the structural region is linked to a 3' non-translated sequence that functions in the plant to cause termination of transcription and addition of polyadenylated ribonucleotides to a 3' end of a mRNA molecule; and wherein the functional nucleic acid molecule results in overexpression of the plant methionine pathway enzyme; and (B) growing the transformed plant.

The present invention also provides a method of producing a plant containing an overexpressed plant methionine pathway enzyme comprising: (A) transforming the plant with a functional nucleic acid molecule, wherein the functional nucleic acid molecule comprises a promoter region, wherein the promoter region is linked to a structural region, wherein the structural region comprises a nucleic acid molecule selected from the group consisting of a nucleic acid molecule that encodes a maize or a soybean methionine adenosyltransferase enzyme or fragment thereof, a nucleic acid molecule that encodes a maize or a soybean S-adenosylmethionine decarboxylase enzyme or fragment thereof, a nucleic acid molecule that encodes a maize or a soybean aspartate kinase enzyme or fragment thereof, a nucleic acid molecule that encodes a maize or a soybean aspartate-semialdehyde dehydrogenase enzyme or fragment thereof, a nucleic acid molecule that encodes a maize or a soybean O-succinylhomoserine (thiol)-lyase enzyme or fragment thereof, a nucleic acid molecule that encodes a maize or a soybean cystathionine β-lyase enzyme or fragment thereof, a nucleic acid molecule that encodes a maize or a soybean 5-methyltetrahydropteroyltriglutamate-homocysteine-S-methyltransferase enzyme or fragment thereof, a nucleic acid molecule that encodes a maize or a soybean adenosylhomocysteinase enzyme or fragment thereof, a nucleic acid molecule that encodes a maize or a soybean cystathionine β-synthase enzyme or fragment thereof, a nucleic acid molecule that encodes a maize or a soybean cystathionine γ-lyase enzyme or fragment thereof and a nucleic acid molecule that encodes a maize or a soybean O-acetylhomoserine (thiol)-lyase enzyme or fragment thereof; wherein the structural region is linked to a 3' non-translated sequence that functions in the plant to cause termination of transcription and addition of polyadenylated ribonucleotides to a 3' end of a mRNA molecule; and wherein the functional nucleic acid molecule results in overexpression of the plant methionine pathway enzyme protein; and (B) growing the transformed plant.

The present invention also provides a method of producing a plant containing reduced levels of a plant methionine pathway enzyme comprising: (A) transforming the plant with a functional nucleic acid molecule, wherein the functional nucleic acid molecule comprises a promoter region, wherein the promoter region is linked to a structural region, wherein the structural region comprises a nucleic acid molecule having a nucleic acid sequence selected from the group consisting of SEQ ID NO: 1 through SEQ ID NO: 3204; wherein the structural region is linked to a 3' non-translated sequence that functions in the plant to cause termination of transcription and addition of polyadenylated ribonucleotides to a 3' end of a mRNA molecule; and wherein the functional nucleic acid molecule results in co-suppression of the plant methionine pathway enzyme protein; and (B) growing the transformed plant.

The present invention also provides a method of producing a plant containing reduced levels of a plant methionine pathway enzyme comprising: (A) transforming the plant with a functional nucleic acid molecule, wherein the functional nucleic acid molecule comprises a promoter region, wherein the promoter region is linked to a structural region, wherein the structural region comprises a nucleic acid molecule having a nucleic acid sequence selected from the group consisting of a nucleic acid molecule that encodes a maize or a soybean methionine adenosyltransferase enzyme or fragment thereof, a nucleic acid molecule that encodes a maize or a soybean S-adenosylmethionine decarboxylase enzyme or fragment thereof, a nucleic acid molecule that encodes a maize or a soybean aspartate kinase enzyme or fragment thereof, a nucleic acid molecule that encodes a maize or a soybean aspartate-semialdehyde dehydrogenase enzyme or fragment thereof, a nucleic acid molecule that encodes a maize or a soybean O-succinylhomoserine (thiol)-lyase enzyme or fragment thereof, a nucleic acid molecule that encodes a maize or a soybean cystathionine β-lyase enzyme or fragment thereof, a nucleic acid molecule that encodes a maize or a soybean 5-methyltetrahydropteroyltriglutamate-homocysteine-S-methyltransferase enzyme or fragment thereof, a nucleic acid molecule that encodes a maize or a soybean adenosylhomocysteinase enzyme or fragment thereof, a nucleic acid molecule that encodes a maize or a soybean cystathionine β-synthase enzyme or fragment thereof, a nucleic acid molecule that encodes a maize or a soybean cystathionine γ-lyase enzyme or fragment thereof and a nucleic acid molecule that encodes a maize or a soybean O-acetylhomoserine (thiol)-lyase enzyme or fragment thereof; wherein the structural region is linked to a 3' non-translated sequence that functions in the plant to cause termination of transcription and addition of polyadenylated ribonucleotides to a 3' end of a mRNA molecule; and wherein the functional nucleic acid molecule results in co-suppression of the plant methionine pathway enzyme; and (B) growing the transformed plant.

The present invention also provides a method for reducing expression of a plant methionine pathway enzyme in a plant comprising: (A) transforming the plant with a nucleic acid molecule, the nucleic acid molecule having an exogenous promoter region which functions in a plant cell to cause the production of a mRNA molecule, wherein the exogenous promoter region is linked to a transcribed nucleic acid molecule having a transcribed strand and a non-transcribed strand, wherein the transcribed strand is complementary to a nucleic acid molecule having a nucleic acid sequence selected from the group consisting of SEQ ID NO: 1 through SEQ ID NO: 3204 or complements thereof or fragments of either and the transcribed strand is complementary to an endogenous mRNA molecule; and wherein the transcribed nucleic acid molecule is linked to a 3' non-translated sequence that functions in the plant cell to cause termination of transcription and addition of polyadenylated ribonucleotides to a 3' end of a mRNA molecule; and (B) growing the transformed plant.

The present invention also provides a method for reducing expression of a plant methionine pathway enzyme in a plant comprising: (A) transforming the plant with a nucleic acid molecule, the nucleic acid molecule having an exogenous promoter region which functions in a plant cell to cause the production of a mRNA molecule, wherein the exogenous promoter region is linked to a transcribed nucleic acid molecule having a transcribed strand and a non-transcribed strand, wherein a transcribed mRNA of the transcribed strand is complementary to a nucleic acid molecule selected from the group consisting of an endogenous mRNA molecule that encodes a maize or a soybean methionine adenosyltransferase enzyme or fragment thereof, an endogenous mRNA molecule that encodes a maize or a soybean S-adenosylmethionine decarboxylase enzyme or fragment thereof, an endogenous mRNA molecule that encodes a maize or a soybean aspartate kinase enzyme or fragment thereof, an endogenous mRNA molecule that encodes a maize or a soybean aspartate-semialdehyde dehydrogenase enzyme or fragment thereof, an endogenous mRNA molecule that encodes a maize or a soybean O-succinylhomoserine (thiol)-lyase enzyme or fragment thereof, an endogenous mRNA molecule that encodes a maize or a soybean cystathionine β-lyase enzyme or fragment thereof, an endogenous mRNA molecule that encodes a maize or a soybean 5-methyltetrahydropteroyltriglutamate-homocysteine-S-methyltransferase enzyme or fragment thereof, an endogenous mRNA molecule that encodes a maize or a soybean adenosylhomocysteinase enzyme or fragment thereof, an endogenous mRNA molecule that encodes a maize or a soybean cystathionine β-synthase enzyme or fragment thereof, an endogenous mRNA molecule that encodes a maize or a soybean cystathionine γ-lyase enzyme or fragment thereof and an endogenous mRNA molecule that encodes a maize or a soybean O-acetylhomoserine (thiol)-lyase enzyme or fragment thereof; and wherein the transcribed nucleic acid molecule is linked to a 3' non-translated sequence that functions in the plant cell to cause termination of transcription and addition of polyadenylated ribonucleotides to a 3' end of a mRNA molecule; and (B) growing the transformed plant.

The present invention also provides a method of determining an association between a polymorphism and a plant trait comprising: (A) hybridizing a nucleic acid molecule specific for the polymorphism to genetic material of a plant, wherein the nucleic acid molecule has a nucleic acid sequence selected from the group consisting of SEQ ID NO: 1 through SEQ ID NO: 3204 or complements thereof or fragment thereof; and (B) calculating the degree of association between the polymorphism and the plant trait.

The present invention also provides a method of determining an association between a polymorphism and a plant trait comprising: (A) hybridizing a nucleic acid molecule specific for the polymorphism to genetic material of a plant, wherein the nucleic acid molecule is selected from the group consisting of a nucleic acid molecule that encodes a maize or a soybean methionine adenosyltransferase enzyme complement thereof or fragment of either, a nucleic acid molecule that encodes a maize or a soybean S-adenosylmethionine decarboxylase enzyme complement thereof or fragment of either, a nucleic acid molecule that encodes a maize or a soybean aspartate kinase enzyme complement thereof or fragment of either, a nucleic acid molecule that encodes a maize or a soybean aspartate-semialdehyde dehydrogenase enzyme complement thereof or fragment of either, a nucleic acid molecule that encodes a maize or a soybean O-succinylhomoserine (thiol)-lyase enzyme complement thereof or fragment of either, a nucleic acid molecule that encodes a maize or a soybean cystathionine β-lyase enzyme complement thereof or fragment of either, a nucleic acid molecule that encodes a maize or a soybean 5-methyltetrahydropteroyltriglutamate-homocysteine-S-methyltransferase enzyme or complement thereof or fragment of either; a nucleic acid molecule that encodes a maize or a soybean adenosylhomocysteinase enzyme or complement thereof or fragment of either, a nucleic acid molecule that encodes a maize or a soybean cystathionine β-synthase enzyme or complement thereof or fragment of either, a nucleic acid molecule that encodes a maize or a soybean cytsathionine γ-lyase enzyme or complement thereof or fragment of either and a nucleic acid molecule that encodes a maize or a soybean O-acetylhomoserine (thiol)-lyase enzyme or complement thereof or fragment of either and (B) calculating the degree of association between the polymorphism and the plant trait.

The present invention also provides a method of isolating a nucleic acid that encodes a plant methionine pathway enzyme or fragment thereof comprising: (A) incubating under conditions permitting nucleic acid hybridization, a first nucleic acid molecule comprising a nucleic acid sequence selected from the group consisting of SEQ ID NO: 1 through SEQ ID NO: 3204 or complements thereof or fragment of either with a complementary second nucleic acid molecule obtained from a plant cell or plant tissue; (B) permitting hybridization between the first nucleic acid molecule and the second nucleic acid molecule obtained from the plant cell or plant tissue; and (C) isolating the second nucleic acid molecule.

The present invention also provides a method of isolating a nucleic acid molecule that encodes a plant methionine pathway enzyme or fragment thereof comprising: (A) incubating under conditions permitting nucleic acid hybridization, a first nucleic acid molecule selected from the group consisting of a nucleic acid molecule that encodes a maize or a soybean methionine adenosyltransferase enzyme complement thereof or fragment of either, a nucleic acid molecule that encodes a maize or a soybean S-adenosylmethionine decarboxylase enzyme or complement thereof or fragment of either, a nucleic acid molecule that encodes a maize or a soybean aspartate kinase enzyme complement thereof or fragment of either, a nucleic acid molecule that encodes a maize or a soybean aspartate-semialdehyde dehydrogenase enzyme or complement thereof or fragment of either, a nucleic acid molecule that encodes a maize or a soybean O-succinylhomoserine (thiol)-lyase enzyme or complement thereof or fragment of either and a nucleic acid molecule that encodes a maize or a soybean cystathionine β-lyase enzyme or complement thereof or fragment of either, a nucleic acid molecule that encodes a maize or a soybean 5-methyltetrahydropteroyltriglutamate-homocysteine-S-methyltransferase enzyme or complement thereof or fragment of either, a nucleic acid molecule that encodes a maize or a soybean adenosylhomocysteinase enzyme or complement thereof or fragment of either, a nucleic acid molecule that encodes a maize or a soybean cystathionine β-synthase enzyme or complement thereof or fragment of either, a nucleic acid molecule that encodes a maize or a soybean cytsathionine γ-lyase enzyme or complement thereof or fragment of either and a nucleic acid molecule that encodes a maize or a soybean O-acetylhomoserine (thiol)-lyase enzyme or complement thereof or fragment of either, with a complementary second nucleic acid molecule obtained from a plant cell or plant tissue; (B) permitting hybridization between the plant methionine pathway nucleic acid molecule and the complementary nucleic acid molecule obtained from the plant cell or plant tissue; and (C) isolating the second nucleic acid molecule.

DETAILED DESCRIPTION OF THE INVENTION

Definitions and Agents of the Present Invention

Definitions

As used herein, a methionine pathway enzyme is any enzyme that is associated with the synthesis or degradation of methionine.

As used herein, a methionine synthesis enzyme is any enzyme that is associated with the synthesis of methionine.

As used herein, a methionine degradation enzyme is any enzyme that is associated with the degradation of methionine.

As used herein, methionine adenosyltransferase is any enzyme that catalyzes the conversion of methionine to S-adenosylmethionine.

As used herein, S-adenosylmethionine decarboxylase is any enzyme that catalyzes the reaction that converts S-adenosylmethionine to (5-deoxy-5-adenosyl)(3-aminopropyl)methylsulfonuim salt.

As used herein, aspartate kinase is any enzyme that catalyzes the conversion of aspartate to β-aspartyl phosphate.

As used herein, aspartate semialdehyde dehydrogenase is any enzyme that catalyzes the conversion of β-aspartyl phosphate to aspartate-semialdehyde via an NADPH-dependent reaction.

As used herein, O-succinylhomoserine (thiol)-lyase refers to any enzyme that catalyzes the conversion of O-phosphohomoserine to and cysteine to cystathionine.

As used herein, cystathionine β-lyase is any enzyme that catalyzes the conversion of cystathionine to homocysteine, pyruvate and ammonia.

As used herein, 5-methyltetrhydropterolytriglutamate-homocysteine S-methyltransferase refers to any enzyme which catalyzes the conversion of homocysteine via methylation to methionine.

As used herein, adenosylhomocysteinase refers to any enzyme that catalyzes the ATP-dependent conversion of S-adenosylmethionine (AdoMet) to methylthioadenosine and L-homoserine.

As used herein, cystathionine β-synthase refers to any enzyme that catalyzes the conversion of homocysteine and serine to cystathionine.

As used herein, cystathionine γ-lyase refers to any enzyme that catalyzes the γ cleavage of cystationine.

As used herein, O-acetyhomoserine (thiol)-lyase refers to any enzyme that catalyzes the conversion of O-acetylhomoserine and sulfur to homocysteine.

Agents (a) Nucleic Acid Molecules

Agents of the present invention include plant nucleic acid molecules and more specifically include maize and soybean nucleic acid molecules and more specifically include nucleic acid molecules of the maize genotypes B73 (Illinois Foundation Seeds, Champaign, Ill. U.S.A.), B73 x Mo17 (Illinois Foundation Seeds, Champaign, Ill. U.S.A.), DK604 (Dekalb Genetics, Dekalb, Ill. U.S.A.), H99 (Illinois Foundation Seeds, Champaign, Ill. U.S.A.), RX601 (Asgrow Seed Company, Des Moines, Iowa), Mo17 (Illinois Foundation Seeds, Champaign, Ill. U.S.A.), and soybean types Asgrow 3244 (Asgrow Seed Company, Des Moines, Iowa), C1944 (United States Department of Agriculture (USDA) Soybean Germplasm Collection, Urbana, Ill. U.S.A.), Cristalina (USDA Soybean Germplasm Collection, Urbana, Ill. U.S.A.), FT108 (Monsoy, Brazil), Hartwig (USDA Soybean Germplasm Collection, Urbana, Ill. U.S.A.), BW211S Null (Tohoku University, Morioka, Japan), PI507354 (USDA Soybean Germplasm Collection, Urbana, Ill. U.S.A.), Asgrow A4922 (Asgrow Seed Company, Des Moines, Iowa U.S.A.), PI227687 (USDA Soybean Germplasm Collection, Urbana, Ill. U.S.A.), PI229358 (USDA Soybean Germplasm Collection, Urbana, Ill. U.S.A.) and Asgrow A3237 (Asgrow Seed Company, Des Moines, Iowa U.S.A.).

A subset of the nucleic acid molecules of the present invention includes nucleic acid molecules that are marker molecules. Another subset of the nucleic acid molecules of the present invention include nucleic acid molecules that encode a protein or fragment thereof. Another subset of the nucleic acid molecules of the present invention are EST molecules.

Fragment nucleic acid molecules may encode significant portion(s) of, or indeed most of, these nucleic acid molecules. Alternatively, the fragments may comprise smaller oligonucleotides (having from about 15 to about 250 nucleotide residues and more preferably, about 15 to about 30 nucleotide residues).

As used herein, an agent, be it a naturally occurring molecule or otherwise may be "substantially purified," if desired, such that one or more molecules that is or may be present in a naturally occurring preparation containing that molecule will have been removed or will be present at a lower concentration than that at which it would normally be found.

The agents of the present invention will preferably be "biologically active" with respect to either a structural attribute, such as the capacity of a nucleic acid to hybridize to another nucleic acid molecule, or the ability of a protein to be bound by an antibody (or to compete with another molecule for such binding). Alternatively, such an attribute may be catalytic and thus involve the capacity of the agent to mediate a chemical reaction or response.

The agents of the present invention may also be recombinant. As used herein, the term recombinant means any agent (e.g. DNA, peptide etc.), that is, or results, however indirect, from human manipulation of a nucleic acid molecule.

It is understood that the agents of the present invention may be labeled with reagents that facilitate detection of the agent (e.g. fluorescent labels, Prober et al., *Science* 238:336-340 (1987); Albarella et al., EP 144914; chemical labels, Sheldon et al., U.S. Pat. No. 4,582,789; Albarella et al., U.S. Pat. No. 4,563,417; modified bases, Miyoshi et al., EP 119448, all of which are hereby incorporated by reference in their entirety).

It is further understood, that the present invention provides recombinant bacterial, mammalian, microbial, insect, fungal and plant cells and viral constructs comprising the agents of the present invention. (See, for example, Uses of the Agents of the Invention, Section (a) Plant Constructs and Plant Transformants; Section (b) Fungal Constructs and Fungal Transformants; Section (c) Mammalian Constructs and Transformed Mammalian Cells; Section (d) Insect Constructs and Transformed Insect Cells; and Section (e) Bacterial Constructs and Transformed Bacterial Cells)

Nucleic acid molecules or fragments thereof of the present invention are capable of specifically hybridizing to other nucleic acid molecules under certain circumstances. As used herein, two nucleic acid molecules are said to be capable of specifically hybridizing to one another if the two molecules are capable of forming an anti-parallel, double-stranded nucleic acid structure. A nucleic acid molecule is said to be the "complement" of another nucleic acid molecule if they exhibit complete complementarity. As used herein, molecules are said to exhibit "complete complementarity" when every nucleotide of one of the molecules is complementary to a nucleotide of the other. Two molecules are said to be "minimally complementary" if they can hybridize to one another with sufficient stability to permit them to remain annealed to one another under at least conventional "low-stringency" conditions. Similarly, the molecules are said to be "complementary" if they can hybridize to one another with sufficient stability to permit them to remain annealed to one another under conventional "high-stringency" conditions. Conventional stringency conditions are described by Sambrook et al., *Molecular Cloning*, A Laboratory Manual, 2nd Ed., Cold Spring Harbor Press, Cold Spring Harbor, N.Y. (1989) and by Haymes et al., *Nucleic Acid Hybridization, A Practical Approach*, IRL Press, Washington, D.C. (1985), the entirety of which is herein incorporated by reference. Departures from complete complementarity are therefore permissible, as long as such departures do not completely preclude the capacity of the molecules to form a double-stranded structure. Thus, in order for a nucleic acid molecule to serve as a primer or probe it need only be sufficiently complementary in sequence to be able to form a stable double-stranded structure under the particular solvent and salt concentrations employed.

Appropriate stringency conditions which promote DNA hybridization, for example, 6.0× sodium chloride/sodium citrate (SSC) at about 45° C., followed by a wash of 2.0×SSC at 50° C., are known to those skilled in the art or can be found in *Current Protocols in Molecular Biology*, John Wiley & Sons, N.Y. (1989), 6.3.1-6.3.6. For example, the salt concentration in the wash step can be selected from a low stringency of about 2.0×SSC at 50° C. to a high stringency of about 0.2× SSC at 50° C. In addition, the temperature in the wash step can be increased from low stringency conditions at room temperature, about 22° C., to high stringency conditions at about 65° C. Both temperature and salt may be varied, or either the temperature or the salt concentration may be held constant while the other variable is changed.

In a preferred embodiment, a nucleic acid of the present invention will specifically hybridize to one or more of the nucleic acid molecules set forth in SEQ ID NO: 1 through SEQ ID NO: 3204 or complements thereof under moderately stringent conditions, for example at about 2.0×SSC and about 65° C.

In a particularly preferred embodiment, a nucleic acid of the present invention will include those nucleic acid molecules that specifically hybridize to one or more of the nucleic acid molecules set forth in SEQ ID NO: 1 through SEQ ID NO: 3204 or complements thereof under high stringency conditions such as 0.2×SSC and about 65° C.

In one aspect of the present invention, the nucleic acid molecules of the present invention have one or more of the nucleic acid sequences set forth in SEQ ID NO: 1 through SEQ ID NO: 3204 or complements thereof. In another aspect of the present invention, one or more of the nucleic acid molecules of the present invention share between 100% and 90% sequence identity with one or more of the nucleic acid sequences set forth in SEQ ID NO: 1 through SEQ ID NO: 3204 or complements thereof. In a further aspect of the present invention, one or more of the nucleic acid molecules of the present invention share between 100% and 95% sequence identity with one or more of the nucleic acid sequences set forth in SEQ ID NO: 1 through SEQ ID NO: 3204 or complements thereof. In a more preferred aspect of the present invention, one or more of the nucleic acid molecules of the present invention share between 100% and 98% sequence identity with one or more of the nucleic acid sequences set forth in SEQ ID NO: 1 through SEQ ID NO: 3204 or complements thereof. In an even more preferred aspect of the present invention, one or more of the nucleic acid molecules of the present invention share between 100% and 99% sequence identity with one or more of the sequences set forth in SEQ ID NO: 1 through SEQ ID NO: 3204 or complements thereof.

In a further more preferred aspect of the present invention, one or more of the nucleic acid molecules of the present invention exhibit 100% sequence identity with a nucleic acid molecule present within MONN01, SATMON001 through SATMON031, SATMON033, SATMON034, SATMON~001, SATMONN01, SATMONN04 through SATMONN006, CMz029 through CMz031, CMz033, CMz035 through CMz037, CMz039 through CMz042, CMz044 through CMz045, CMz047 through CMz050, SOYMON001 through SOYMON038, Soy51 through Soy56, Soy58 through Soy62, Soy65 through Soy66, Soy 68 through Soy73 and Soy76 through Soy77, Lib9, Lib22 through Lib25, Lib35, Lib80 through Lib81, Lib 144, Lib146, Lib147, Lib190, Lib3032 through Lib3036 and Lib3099 (Monsanto Company, St. Louis, Mo. U.S.A.).

(i) Nucleic Acid Molecules Encoding Proteins or Fragments Thereof

Nucleic acid molecules of the present invention can comprise sequences that encode a methionine pathway protein or fragment thereof. Such proteins or fragments thereof include homologues of known proteins in other organisms.

In a preferred embodiment of the present invention, a maize or soybean protein homologue or fragment thereof of the present invention is a homologue of another plant protein. In another preferred embodiment of the present invention, a maize or soybean protein homologue or fragment thereof of the present invention is a homologue of a fungal protein. In another preferred embodiment of the present invention, a maize or soybean protein homologue of the present invention is a homologue of mammalian protein. In another preferred embodiment of the present invention, a maize or soybean protein homologue or fragment thereof of the present invention is a homologue of a bacterial protein. In another preferred embodiment of the present invention, a soybean protein homologue or fragment thereof of the present invention is a homologue of a maize protein. In another preferred embodiment of the present invention, a maize protein homologue or fragment thereof of the present invention is a homologue of a soybean protein.

In a preferred embodiment of the present invention, the nucleic molecule of the present invention encodes a maize or soybean homologue protein or fragment thereof where a maize or soybean homologue protein exhibits a BLAST probability score of greater than 1E-12, preferably a BLAST probability score of between about 1E-30 and about 1E-12, even more preferably a BLAST probability score of greater than 1E-30 with its homologue.

In another preferred embodiment of the present invention, the nucleic acid molecule encoding a maize or soybean protein homologue or fragment thereof or fragment thereof exhibits a % identity with its homologue of between about 25% and about 40%, more preferably of between about 40 and about 70%, even more preferably of between about 70% and about 90% and even more preferably between about 90% and 99%. In another preferred embodiment, of the present invention, a maize or soybean protein homologue or fragments thereof exhibits a % identity with its homologue of 100%.

In a preferred embodiment of the present invention, the nucleic molecule of the present invention encodes a maize or soybean homologue protein or fragment thereof where a maize or soybean homologue protein exhibits a BLAST score of greater than 120, preferably a BLAST score of between about 1450 and about 120, even more preferably a BLAST score of greater than 1450 with its homologue.

Nucleic acid molecules of the present invention also include non-maize, non-soybean homologues. Preferred non-homologues are selected from the group consisting of alfalfa, *Arabidopsis*, barley, *Brassica*, broccoli, cabbage, citrus, cotton, garlic, oat, oilseed rape, onion, canola, flax, an ornamental plant, pea, peanut, pepper, potato, rice, rye, sorghum, strawberry, sugarcane, sugarbeet, tomato, wheat, poplar, pine, fir, eucalyptus, apple, lettuce, lentils, grape, banana, tea, turf grasses, sunflower, oil palm and *Phaseolus*.

In a preferred embodiment, nucleic acid molecules having SEQ ID NO: 1 through SEQ ID NO: 3204 or complements and fragments of either can be utilized to obtain such homologues.

The degeneracy of the genetic code, which allows different nucleic acid sequences to code for the same protein or peptide, is known in the literature. (U.S. Pat. No. 4,757,006, the entirety of which is herein incorporated by reference).

In an aspect of the present invention, one or more of the nucleic acid molecules of the present invention differ in nucleic acid sequence from those encoding maize or soybean homologue or fragment thereof in SEQ ID NO: 1 through SEQ ID NO: 3204 due to the degeneracy in the genetic code in that they encode the same protein but differ in nucleic acid sequence.

In another further aspect of the present invention, one or more of the nucleic acid molecules of the present invention differ in nucleic acid sequence from those encoding maize or soybean homologue or fragment thereof in SEQ ID NO: 1 through SEQ ID NO: 3204 due to fact that the different nucleic acid sequence encodes a protein having one or more conservative amino acid residue. Examples of conservative substitutions are set forth in Table 1. It is understood that codons capable of coding for such conservative substitutions are known in the art.

TABLE 1

| Original Residue | Conservative Substitutions |
|---|---|
| Ala | Ser |
| Arg | Lys |
| Asn | Gln; His |
| Asp | Glu |
| Cys | Ser; Ala |
| Gln | Asn |
| Glu | Asp |
| Gly | Pro |
| His | Asn; Gln |
| Ile | Leu; Val |
| Leu | Ile; Val |
| Lys | Arg; Gln; Glu |
| Met | Leu; Ile |
| Phe | Met; Leu; Tyr |
| Ser | Thr |
| Thr | Ser |
| Trp | Tyr |
| Tyr | Trp; Phe |
| Val | Ile; Leu |

In a further aspect of the present invention, one or more of the nucleic acid molecules of the present invention differ in nucleic acid sequence from those encoding a maize or soybean homologue or fragment thereof set forth in SEQ ID NO: 1 through SEQ ID NO: 3204 or fragment thereof due to the fact that one or more codons encoding an amino acid has been substituted for a codon that encodes a nonessential substitution of the amino acid originally encoded.

Agents of the present invention include nucleic acid molecules that encode a maize or soybean methionine pathway protein or fragment thereof and particularly substantially purified nucleic acid molecules selected from the group consisting of a nucleic acid molecule that encodes a maize or soybean methionine adenosyltransferase protein or fragment thereof, a nucleic acid molecule that encodes a maize or soybean S-adenosylmethionine decarboxylase protein or fragment thereof, a nucleic acid molecule that encodes a maize or soybean aspartate kinase protein or fragment thereof, a nucleic acid molecule that encode a maize or soybean aspartate-semialdehyde dehydrogenase protein or fragment thereof, a nucleic acid molecule that encodes a maize or soybean O-succinylhomoserine (thiol)-lyase protein or fragment thereof, a nucleic acid molecule that encodes a maize or soybean cystathionine β-lyase protein or fragment thereof, a nucleic acid molecule that encodes a maize or soybean 5-methyltetrahydropteroyltriglutamate-homocysteine-S-methyltransferase protein or fragment thereof, a nucleic acid molecule that encodes a maize or soybean adenosylhomocysteine protein or fragment thereof, a nucleic acid molecule that encodes a maize or soybean cystathionine β-synthase protein or fragment thereof, a nucleic acid molecule that encodes a maize or soybean cystathionine γ-lyase protein or fragment thereof, and a nucleic acid molecule that encodes a maize or soybean O-acetylhomoserine (thiol)-lyase protein or fragment thereof.

Non-limiting examples of such nucleic acid molecules of the present invention are nucleic acid molecules comprising: SEQ ID NO: 1 through SEQ ID NO: 3204 or fragment thereof that encode for a methionine pathway protein or fragment thereof, SEQ ID NO: 1 through SEQ ID NO: 429 and SEQ ID NO: 1635 through SEQ ID NO: 2479 or fragment thereof that encode for a methionine adenosyltransferase protein or fragment thereof, SEQ ID NO: 430 through SEQ ID NO: 857 and SEQ ID NO: 2480 through SEQ ID NO: 2623 or fragment thereof that encode for a S-adenosylmethionine decarboxylase protein or fragment thereof, SEQ ID NO: 858 through SEQ ID NO: 900 and SEQ ID NO: 2624 through SEQ ID NO: 2648 or fragment thereof that encode for a aspartate kinase protein or fragment thereof, SEQ ID NO: 901 through SEQ ID NO: 904 and SEQ ID NO: 2649 through SEQ ID NO: 2654 or fragment thereof that encode for a aspartate-semialdehyde dehydrogenase protein or fragment thereof, SEQ ID NO: 905 through SEQ ID NO: 953 and SEQ ID NO: 2655 through SEQ ID NO: 2660 or fragment thereof that encode for a O-succinylhomoserine (thiol)-lyase protein or fragment thereof, SEQ ID NO: 954 through SEQ ID NO: 963 and SEQ ID NO: 2655 through SEQ ID NO: 2660 or fragment thereof that encode for a cystathionine β-lyase protein or fragment thereof, SEQ ID NO: 964 through SEQ ID NO: 1353 and SEQ ID NO: 2666 through SEQ ID NO: 2992 or fragment thereof that encode for a 5-methyltetrahydropteroyltriglutamate-homocysteine-S-methyltransferase protein or fragment thereof, SEQ ID NO: 1354 through SEQ ID NO: 1630 and SEQ ID NO: 2993 through SEQ ID NO: 3199 or fragment thereof that encode for an adenosylhomocysteinase protein or fragment thereof, SEQ ID NO: 1631 through SEQ ID NO: 1632 or fragment thereof that encode for a cystathionine β-synthase protein or fragment thereof, SEQ ID NO: 1633 through SEQ ID NO: 1634 and SEQ ID NO: 3203 through SEQ ID NO: 3204 or fragment thereof that encode for a cystathionine γ-lyase protein or fragment thereof, and SEQ ID NO: 3200 through SEQ ID NO: 3202 or fragment thereof that encode for an O-acetylhomoserine (thiol)-lyase protein or fragment thereof.

A nucleic acid molecule of the present invention can also encode an homologue of a maize or soybean methionine adenosyltransferase or fragment thereof, a maize or soybean S-adenosylmethionine decarboxylase or fragment thereof, a maize or soybean aspartate kinase or fragment thereof, a maize or soybean aspartate-semialdehyde dehydrogenase or fragment thereof, a maize or soybean O-succinylhomoserine (thiol)-lyase or fragment thereof, a maize or soybean cystathionine β-lyase or fragment thereof, a maize or soybean 5-methyltetrahydropteroyltriglutamate-homocysteine-S-methyltransferase or fragment thereof, a maize or soybean adenosylhomocysteinease or fragment thereof, a maize or soybean cystathionine β-synthase or fragment thereof, a maize or soybean cystathionine γ-lyase or fragment thereof or a maize or soybean O-acetylhomoserine (thiol)-lyase or fragment thereof. As used herein a homologue protein molecule or fragment thereof is a counterpart protein molecule or fragment thereof in a second species (e.g., maize methionine adenosyltransferase protein is a homologue of *Arabidopsis*' methionine adenosyltransferase protein).

(ii) Nucleic Acid Molecule Markers and Probes

One aspect of the present invention concerns markers that include nucleic acid molecules SEQ ID NO: 1 through SEQ ID NO: 3204 or complements thereof or fragments of either that can act as markers. Genetic markers of the present invention include "dominant" or "codominant" markers. "Codominant markers" reveal the presence of two or more alleles (two per diploid individual) at a locus. "Dominant markers" reveal the presence of only a single allele per locus. The presence of the dominant marker phenotype (e.g., a band of DNA) is an indication that one allele is present in either the homozygous or heterozygous condition. The absence of the dominant marker phenotype (e.g. absence of a DNA band) is merely evidence that "some other" undefined allele is present. In the case of populations where individuals are predominantly homozygous and loci are predominately dimorphic, dominant and codominant markers can be equally valuable. As populations become more heterozygous and multi-allelic, codominant markers often become more informative of the genotype than dominant markers. Marker molecules can be, for example, capable of detecting polymorphisms such as single nucleotide polymorphisms (SNPs).

SNPs are single base changes in genomic DNA sequence. They occur at greater frequency and are spaced with a greater uniformity throughout a genome than other reported forms of polymorphism. The greater frequency and uniformity of SNPs means that there is greater probability that such a polymorphism will be found near or in a genetic locus of interest than would be the case for other polymorphisms. SNPs are located in protein-coding regions and noncoding regions of a genome. Some of these SNPs may result in defective or variant protein expression (e.g., as a results of mutations or defective splicing). Analysis (genotyping) of characterized SNPs can require only a plus/minus assay rather than a lengthy measurement, permitting easier automation.

SNPs can be characterized using any of a variety of methods. Such methods include the direct or indirect sequencing of the site, the use of restriction enzymes (Botstein et al., *Am. J. Hum. Genet.* 32:314-331 (1980), the entirety of which is herein incorporated reference; Konieczny and Ausubel, *Plant J.* 4:403-410 (1993), the entirety of which is herein incorporated by reference), enzymatic and chemical mismatch assays (Myers et al., *Nature* 313:495-498 (1985), the entirety of which is herein incorporated by reference), allele-specific PCR (Newton et al., *Nucl. Acids Res.* 17:2503-2516 (1989), the entirety of which is herein incorporated by reference; Wu et al., *Proc. Natl. Acad. Sci.* (*U.S.A.*) 86:2757-2760 (1989), the entirety of which is herein incorporated by reference), ligase chain reaction (Barany, *Proc. Natl. Acad. Sci.* (*U.S.A.*) 88:189-193 (1991), the entirety of which is herein incorporated by reference), single-strand conformation polymorphism analysis (Labrune et al., *Am. J. Hum. Genet.* 48: 1115-1120 (1991), the entirety of which is herein incorporated by reference), primer-directed nucleotide incorporation assays (Kuppuswami et al., *Proc. Natl. Acad. Sci. USA* 88:1143-1147 (1991), the entirety of which is herein incorporated by reference), dideoxy fingerprinting (Sarkar et al., *Genomics* 13:441-443 (1992), the entirety of which is herein incorporated by reference), solid-phase ELISA-based oligonucleotide ligation assays (Nikiforov et al., *Nucl. Acids Res.* 22:4167-4175 (1994), the entirety of which is herein incorporated by reference), oligonucleotide fluorescence-quenching assays (Livak et al., *PCR Methods Appl.* 4:357-362 (1995), the entirety of which is herein incorporated by reference), 5'-nuclease allele-specific hybridization TaqMan assay (Livak et al., *Nature Genet.* 9:341-342 (1995), the entirety of which is herein incorporated by reference), template-directed dye-terminator incorporation (TDI) assay (Chen and Kwok, *Nucl. Acids Res.* 25:347-353 (1997), the entirety of which is herein incorporated by reference), allele-specific molecular beacon assay (Tyagi et al., *Nature Biotech.* 16: 49-53 (1998), the entirety of which is herein incorporated by reference), PinPoint assay (Haff and Smimov, *Genome Res.* 7: 378-388 (1997), the entirety of which is herein incorporated by reference) and dCAPS analysis (Neff et al., *Plant J.* 14:387-392 (1998), the entirety of which is herein incorporated by reference).

Additional markers, such as AFLP markers, RFLP markers and RAPD markers, can be utilized (Walton, *Seed World* 22-29 (July, 1993), the entirety of which is herein incorporated by reference; Burow and Blake, *Molecular Dissection of Complex Traits,* 13-29, Paterson (ed.), CRC Press, New York (1988), the entirety of which is herein incorporated by reference). DNA markers can be developed from nucleic acid molecules using restriction endonucleases, the PCR and/or DNA sequence information. RFLP markers result from single base changes or insertions/deletions. These codominant markers are highly abundant in plant genomes, have a medium level of polymorphism and are developed by a combination of restriction endonuclease digestion and Southern blotting hybridization. CAPS are similarly developed from restriction nuclease digestion but only of specific PCR products. These markers are also codominant, have a medium level of polymorphism and are highly abundant in the genome. The CAPS result from single base changes and insertions/deletions.

Another marker type, RAPDs, are developed from DNA amplification with random primers and result from single base changes and insertions/deletions in plant genomes. They are dominant markers with a medium level of polymorphisms and are highly abundant. AFLP markers require using the PCR on a subset of restriction fragments from extended adapter primers. These markers are both dominant and codominant are highly abundant in genomes and exhibit a medium level of polymorphism.

SSRs require DNA sequence information. These codominant markers result from repeat length changes, are highly polymorphic and do not exhibit as high a degree of abundance in the genome as CAPS, AFLPs and RAPDs SNPs also require DNA sequence information. These codominant markers result from single base substitutions. They are highly abundant and exhibit a medium of polymorphism (Rafalski et al., In: *Nonmammalian Genomic Analysis*, Birren and Lai (ed.), Academic Press, San Diego, Calif., pp. 75-134 (1996), the entirety of which is herein incorporated by reference). It is understood that a nucleic acid molecule of the present invention may be used as a marker.

A PCR probe is a nucleic acid molecule capable of initiating a polymerase activity while in a double-stranded structure to with another nucleic acid. Various methods for determining the structure of PCR probes and PCR techniques exist in the art. Computer generated searches using programs such as Primer3 (on the Worldwide web at genome.wi.mit.edu/cgi-bin/primer/primer3.cgi), STSPipeline (on the Worldwide web at genome.wi.mit.edu/cgi-bin/www-STS_Pipeline), or GeneUp (Pesole et al., *Bio Techniques* 25:112-123 (1998) the entirety of which is herein incorporated by reference), for example, can be used to identify potential PCR primers.

It is understood that a fragment of one or more of the nucleic acid molecules of the present invention may be a probe and specifically a PCR probe.

(b) Protein and Peptide Molecules

A class of agents comprises one or more of the protein or fragments thereof or peptide molecules encoded by SEQ ID NO: 1 through SEQ ID NO: 3204 or one or more of the protein or fragment thereof and peptide molecules encoded by other nucleic acid agents of the present invention. As used herein, the term "protein molecule" or "peptide molecule" includes any molecule that comprises five or more amino acids. It is well known in the art that proteins may undergo modification, including post-translational modifications, such as, but not limited to, disulfide bond formation, glycosylation, phosphorylation, or oligomerization. Thus, as used herein, the term "protein molecule" or "peptide molecule" includes any protein molecule that is modified by any biological or non-biological process. The terms "amino acid" and "amino acids" refer to all naturally occurring L-amino acids. This definition is meant to include norleucine, ornithine, homocysteine and homoserine.

Non-limiting examples of the protein or fragment thereof of the present invention include a maize or soybean methionine pathway protein or fragment thereof; a maize or soybean methionine adenosyltransferase or fragment thereof, a maize or soybean S-adenosylmethionine decarboxylase or fragment thereof, a maize or soybean aspartate kinase or fragment thereof, a maize or soybean aspartate-semialdehyde dehydrogenase or fragment thereof, a maize or soybean O-succinylhomoserine (thiol)-lyase or fragment thereof, a maize or soybean cystathionine β-lyase or fragment thereof, a maize or soybean 5-methyltetrahydropteroyltriglutamate-homocysteine-S-methyltransferase or fragment thereof, a maize or soybean adenosylhomocysteinase or fragment thereof, a maize or soybean cystathionine β-synthase or fragment thereof, a maize or soybean cystathionine γ-lyase or fragment thereof or a maize or soybean O-acetylhomoserine (thiol)-lyase or fragment thereof.

Non-limiting examples of the protein or fragment molecules of the present invention are an methionine pathway protein or fragment thereof encoded by: SEQ ID NO: 1 through SEQ ID NO: 3204 or fragment thereof that encode for a methionine pathway protein or fragment thereof, SEQ ID NO: 1 through SEQ ID NO: 429 and SEQ ID NO: 1635 through SEQ ID NO: 2479 or fragment thereof that encode for a methionine adenosyltransferase protein or fragment thereof, SEQ ID NO: 430 through SEQ ID NO: 857 and SEQ ID NO: 2480 through SEQ ID NO: 2623 or fragment thereof that encode for a S-adenosylmethionine decarboxylase protein or fragment thereof, SEQ ID NO: 858 through SEQ ID NO: 900 and SEQ ID NO: 2624 through SEQ ID NO: 2648 or fragment thereof that encode for a aspartate kinase protein or fragment thereof, SEQ ID NO: 901 through SEQ ID NO: 904 and SEQ ID NO: 2649 through SEQ ID NO: 2654 or fragment thereof that encode for a aspartate-semialdehyde dehydrogenase protein or fragment thereof, SEQ ID NO: 905 through SEQ ID NO: 953 and SEQ ID NO: 2655 through SEQ ID NO: 2660 or fragment thereof that encode for a O-succinylhomoserine (thiol)-lyase protein or fragment thereof, SEQ ID NO: 954 through SEQ ID NO: 963 and SEQ ID NO: 2655 through SEQ ID NO: 2660 or fragment thereof that encode for a cystathionine β-lyase or fragment thereof, SEQ ID NO: 964 through SEQ ID NO: 1353 and SEQ ID NO: 2666 through SEQ ID NO: 2992 or fragment thereof that encode for a 5-methyltetrahydropteroyltriglutamate-homocysteine-S-methyltransferase protein or fragment thereof, SEQ ID NO: 1354 through SEQ ID NO: 1630 and SEQ ID NO: 2993 through SEQ ID NO: 3199 or fragment thereof that encode for an adenosylhomocysteinase protein or fragment thereof, SEQ ID NO: 1631 through SEQ ID NO: 1632 or fragment thereof that encode for a cystathionine β-synthase protein or fragment thereof, SEQ ID NO: 1633 through SEQ ID NO: 1634 and SEQ ID NO: 3203 through SEQ ID NO: 3204 or fragment thereof that encode for a cystathionine γ-lyase protein or fragment thereof, and SEQ ID NO: 3200 through SEQ ID NO: 3202 or fragment thereof that encode for an O-acetylhomoserine (thiol)-lyase protein or fragment thereof.

One or more of the protein or fragment of peptide molecules may be produced via chemical synthesis, or more preferably, by expressing in a suitable bacterial or eucaryotic host. Suitable methods for expression are described by Sambrook et al., (In: *Molecular Cloning, A Laboratory Manual, 2nd Edition, Cold Spring Harbor Press*, Cold Spring Harbor, N.Y. (1989)), or similar texts. For example, the protein may be expressed in, for example, Uses of the Agents of the Invention, Section (a) Plant Constructs and Plant Transformants; Section (b) Fungal Constructs and Fungal Transformants; Section (c) Mammalian Constructs and Transformed Mammalian Cells; Section (d) Insect Constructs and Transformed Insect Cells; and Section (e) Bacterial Constructs and Transformed Bacterial Cells.

A "protein fragment" is a peptide or polypeptide molecule whose amino acid sequence comprises a subset of the amino acid sequence of that protein. A protein or fragment thereof that comprises one or more additional peptide regions not derived from that protein is a "fusion" protein. Such molecules may be derivatized to contain carbohydrate or other moieties (such as keyhole limpet hemocyanin, etc.). Fusion protein or peptide molecules of the present invention are preferably produced via recombinant means.

Another class of agents comprise protein or peptide molecules or fragments or fusions thereof encoded by SEQ ID NO: 1 through SEQ ID NO: 3204 or complements thereof in which conservative, non-essential or non-relevant amino acid residues have been added, replaced or deleted. Computerized means for designing modifications in protein structure are known in the art (Dahiyat and Mayo, *Science* 278:82-87 (1997), the entirety of which is herein incorporated by reference).

The protein molecules of the present invention include plant homologue proteins. An example of such a homologue is a homologue protein of a non-maize or non soybean plant species, that include but not limited to alfalfa, *Arabidopsis*, barley, *Brassica*, broccoli, cabbage, citrus, cotton, garlic, oat, oilseed rape, onion, canola, flax, an ornamental plant, pea, peanut, pepper, potato, rice, rye, sorghum, strawberry, sugarcane, sugarbeet, tomato, wheat, poplar, pine, fir, eucalyptus, apple, lettuce, lentils, grape, banana, tea, turf grasses, sunflower, oil palm, *Phaseolus* etc. Particularly preferred non-maize or non-soybean for use for the isolation of homologs would include, *Arabidopsis*, barley, cotton, oat, oilseed rape, rice, canola, ornamentals, sugarcane, sugarbeet, tomato, potato, wheat and turf grasses. Such a homologue can be obtained by any of a variety of methods. Most preferably, as indicated above, one or more of the disclosed sequences (SEQ ID NO: 1 through SEQ ID NO: 3204 or complements thereof) will be used to define a pair of primers that may be used to isolate the homologue-encoding nucleic acid molecules from any desired species. Such molecules can be expressed to yield homologues by recombinant means.

(c) Antibodies

One aspect of the present invention concerns antibodies, single-chain antigen binding molecules, or other proteins that specifically bind to one or more of the protein or peptide molecules of the present invention and their homologues, fusions or fragments. Such antibodies may be used to quantitatively or qualitatively detect the protein or peptide molecules of the present invention. As used herein, an antibody or peptide is said to "specifically bind" to a protein or peptide molecule of the present invention if such binding is not competitively inhibited by the presence of non-related molecules.

Nucleic acid molecules that encode all or part of the protein of the present invention can be expressed, via recombinant means, to yield protein or peptides that can in turn be used to elicit antibodies that are capable of binding the expressed protein or peptide. Such antibodies may be used in immunoassays for that protein. Such protein-encoding molecules, or their fragments may be a "fusion" molecule (i.e., a part of a larger nucleic acid molecule) such that, upon expression, a fusion protein is produced. It is understood that any of the nucleic acid molecules of the present invention may be expressed, via recombinant means, to yield proteins or peptides encoded by these nucleic acid molecules.

The antibodies that specifically bind proteins and protein fragments of the present invention may be polyclonal or monoclonal and may comprise intact immunoglobulins, or antigen binding portions of immunoglobulins fragments (such as (F(ab'), F(ab')$_2$), or single-chain immunoglobulins producible, for example, via recombinant means. It is understood that practitioners are familiar with the standard resource materials which describe specific conditions and procedures for the construction, manipulation and isolation of antibodies (see, for example, Harlow and Lane, In: *Antibodies: A Laboratory Manual*, Cold Spring Harbor Press, Cold Spring Harbor, N.Y. (1988), the entirety of which is herein incorporated by reference).

Murine monoclonal antibodies are particularly preferred. BALB/c mice are preferred for this purpose, however, equivalent strains may also be used. The animals are preferably immunized with approximately 25 μg of purified protein (or fragment thereof) that has been emulsified in a suitable adjuvant (such as TiterMax adjuvant (Vaxcel, Norcross, Ga.)). Immunization is preferably conducted at two intramuscular sites, one intraperitoneal site and one subcutaneous site at the base of the tail. An additional i.v. injection of approximately 25 μg of antigen is preferably given in normal saline three weeks later. After approximately 11 days following the second injection, the mice may be bled and the blood screened for the presence of anti-protein or peptide antibodies. Preferably, a direct binding Enzyme-Linked Immunoassay (ELISA) is employed for this purpose.

More preferably, the mouse having the highest antibody titer is given a third i.v. injection of approximately 25 μg of the same protein or fragment. The splenic leukocytes from this animal may be recovered 3 days later and then permitted to fuse, most preferably, using polyethylene glycol, with cells of a suitable myeloma cell line (such as, for example, the P3X63Ag8.653 myeloma cell line). Hybridoma cells are selected by culturing the cells under "HAT" (hypoxanthine-aminopterin-thymine) selection for about one week. The resulting clones may then be screened for their capacity to produce monoclonal antibodies ("mAbs"), preferably by direct ELISA.

In one embodiment, anti-protein or peptide monoclonal antibodies are isolated using a fusion of a protein or peptide of the present invention, or conjugate of a protein or peptide of the present invention, as immunogens. Thus, for example, a group of mice can be immunized using a fusion protein emulsified in Freund's complete adjuvant (e.g. approximately 50 μg of antigen per immunization). At three week intervals, an identical amount of antigen is emulsified in Freund's incomplete adjuvant and used to immunize the animals. Ten days following the third immunization, serum samples are taken and evaluated for the presence of antibody. If antibody titers are too low, a fourth booster can be employed. Polysera capable of binding the protein or peptide can also be obtained using this method.

In a preferred procedure for obtaining monoclonal antibodies, the spleens of the above-described immunized mice are removed, disrupted and immune splenocytes are isolated over a ficoll gradient. The isolated splenocytes are fused, using polyethylene glycol with BALB/c-derived HGPRT (hypoxanthine guanine phosphoribosyl transferase) deficient P3x63xAg8.653 plasmacytoma cells. The fused cells are plated into 96 well microtiter plates and screened for hybridoma fusion cells by their capacity to grow in culture medium supplemented with hypothanthine, aminopterin and thymidine for approximately 2-3 weeks.

Hybridoma cells that arise from such incubation are preferably screened for their capacity to produce an immunoglobulin that binds to a protein of interest. An indirect ELISA may be used for this purpose. In brief, the supernatants of hybridomas are incubated in microtiter wells that contain immobilized protein. After washing, the titer of bound immunoglobulin can be determined using, for example, a goat anti-mouse antibody conjugated to horseradish peroxidase. After additional washing, the amount of immobilized enzyme is determined (for example through the use of a chromogenic substrate). Such screening is performed as quickly as possible after the identification of the hybridoma in order to ensure that a desired clone is not overgrown by non-secreting neighbor cells. Desirably, the fusion plates are screened several times since the rates of hybridoma growth vary. In a preferred sub-embodiment, a different antigenic form may be used to screen the hybridoma. Thus, for example, the splenocytes may be immunized with one immunogen, but the resulting hybridomas can be screened using a different immunogen. It is understood that any of the protein or peptide molecules of the present invention may be used to raise antibodies.

As discussed below, such antibody molecules or their fragments may be used for diagnostic purposes. Where the antibodies are intended for diagnostic purposes, it may be desirable to derivatize them, for example with a ligand group (such as biotin) or a detectable marker group (such as a fluorescent group, a radioisotope or an enzyme).

The ability to produce antibodies that bind the protein or peptide molecules of the present invention permits the identification of mimetic compounds of those molecules. A "mimetic compound" is a compound that is not that compound, or a fragment of that compound, but which nonetheless exhibits an ability to specifically bind to antibodies directed against that compound.

It is understood that any of the agents of the present invention can be substantially purified and/or be biologically active and/or recombinant.

Uses of the Agents of the Invention

Nucleic acid molecules and fragments thereof of the present invention may be employed to obtain other nucleic acid molecules from the same species (e.g., ESTs or fragment thereof from maize may be utilized to obtain other nucleic acid molecules from maize). Such nucleic acid molecules include the nucleic acid molecules that encode the complete coding sequence of a protein and promoters and flanking sequences of such molecules. In addition, such nucleic acid molecules include nucleic acid molecules that encode for other isozymes or gene family members. Such molecules can be readily obtained by using the above-described nucleic acid molecules or fragments thereof to screen cDNA or genomic libraries obtained from maize or soybean. Methods for forming such libraries are well known in the art.

Nucleic acid molecules and fragments thereof of the present invention may also be employed to obtain nucleic acid homologues. Such homologues include the nucleic acid molecule of other plants or other organisms (e.g., alfalfa, *Arabidopsis*, barley, *Brassica*, broccoli, cabbage, citrus, cotton, garlic, oat, oilseed rape, onion, canola, flax, an ornamental plant, pea, peanut, pepper, potato, rice, rye, sorghum, strawberry, sugarcane, sugarbeet, tomato, wheat, poplar, pine, fir, eucalyptus, apple, lettuce, lentils, grape, banana, tea, turf grasses, sunflower, oil palm, *Phaseolus*, etc.) including the nucleic acid molecules that encode, in whole or in part, protein homologues of other plant species or other organisms, sequences of genetic elements such as promoters and transcriptional regulatory elements. Such molecules can be readily obtained by using the above-described nucleic acid molecules or fragments thereof to screen cDNA or genomic libraries obtained from such plant species. Methods for forming such libraries are well known in the art. Such homologue molecules may differ in their nucleotide sequences from those found in one or more of SEQ ID NO: 1 through SEQ ID NO: 3204 or complements thereof because complete complementarity is not needed for stable hybridization. The nucleic acid molecules of the present invention therefore also include molecules that, although capable of specifically hybridizing with the nucleic acid molecules may lack "complete complementarity."

Any of a variety of methods may be used to obtain one or more of the above-described nucleic acid molecules (Zamechik et al., *Proc. Natl. Acad. Sci.* (*U.S.A.*) 83:4143-4146 (1986), the entirety of which is herein incorporated by reference; Goodchild et al., *Proc. Natl. Acad. Sci.* (*U.S.A.*) 85:5507-5511 (1988), the entirety of which is herein incorporated by reference; Wickstrom et al., *Proc. Natl. Acad. Sci.* (*U.S.A.*) 85:1028-1032 (1988), the entirety of which is herein incorporated by reference; Holt et al., *Molec. Cell. Biol.* 8:963-973 (1988), the entirety of which is herein incorporated by reference; Gerwirtz et al., *Science* 242:1303-1306 (1988), the entirety of which is herein incorporated by reference; Anfossi et al., *Proc. Natl. Acad. Sci.* (*U.S.A.*) 86:3379-3383 (1989), the entirety of which is herein incorporated by reference; Becker et al., *EMBO J.* 8:3685-3691 (1989); the entirety of which is herein incorporated by reference). Automated nucleic acid synthesizers may be employed for this purpose. In lieu of such synthesis, the disclosed nucleic acid molecules may be used to define a pair of primers that can be used with the polymerase chain reaction (Mullis et al., *Cold Spring Harbor Symp. Quant. Biol.* 51:263-273 (1986); Erlich et al., European Patent 50,424; European Patent 84,796; European Patent 258,017; European Patent 237,362; Mullis, European Patent 201,184; Mullis et al., U.S. Pat. No. 4,683,202; Erlich, U.S. Pat. No. 4,582,788; and Saiki et al., U.S. Pat. No. 4,683,194, all of which are herein incorporated by reference in their entirety) to amplify and obtain any desired nucleic acid molecule or fragment.

Promoter sequence(s) and other genetic elements, including but not limited to transcriptional regulatory flanking sequences, associated with one or more of the disclosed nucleic acid sequences can also be obtained using the disclosed nucleic acid sequence provided herein. In one embodiment, such sequences are obtained by incubating EST nucleic acid molecules or preferably fragments thereof with members of genomic libraries (e.g. maize and soybean) and recovering clones that hybridize to the EST nucleic acid molecule or fragment thereof. In a second embodiment, methods of "chromosome walking," or inverse PCR may be used to obtain such sequences (Frohman et al., *Proc. Natl. Acad. Sci.* (*U.S.A.*) 85:8998-9002 (1988); Ohara et al., *Proc. Natl. Acad. Sci.* (*U.S.A.*) 86:5673-5677 (1989); Pang et al., *Biotechniques* 22:1046-1048 (1977); Huang et al., *Methods Mol. Biol.* 69:89-96 (1997); Huang et al., *Method Mol. Biol.* 67:287-294 (1997); Benkel et al., *Genet. Anal.* 13:123-127 (1996); Hartl et al., *Methods Mol. Biol.* 58:293-301 (1996), all of which are herein incorporated by reference in their entirety).

The nucleic acid molecules of the present invention may be used to isolate promoters of cell enhanced, cell specific, tissue enhanced, tissue specific, developmentally or environmentally regulated expression profiles. Isolation and functional analysis of the 5' flanking promoter sequences of these genes from genomic libraries, for example, using genomic screening methods and PCR techniques would result in the isolation of useful promoters and transcriptional regulatory elements. These methods are known to those of skill in the art and have been described (See, for example, Birren et al., *Genome Analysis: Analyzing DNA*, 1, (1997), Cold Spring Harbor Laboratory Press, Cold Spring Harbor, N.Y., the entirety of which is herein incorporated by reference). Promoters obtained utilizing the nucleic acid molecules of the present invention could also be modified to affect their control characteristics. Examples of such modifications would include but are not limited to enhanced sequences as reported in Uses of the Agents of the Invention, Section (a) Plant Constructs and Plant Transformants. Such genetic elements could be used to enhance gene expression of new and existing traits for crop improvements.

In one sub-aspect, such an analysis is conducted by determining the presence and/or identity of polymorphism(s) by one or more of the nucleic acid molecules of the present invention and more preferably one or more of the EST nucleic acid molecule or fragment thereof which are associated with a phenotype, or a predisposition to that phenotype.

Any of a variety of molecules can be used to identify such polymorphism(s). In one embodiment, one or more of the EST nucleic acid molecules (or a sub-fragment thereof) may be employed as a marker nucleic acid molecule to identify such polymorphism(s). Alternatively, such polymorphisms can be detected through the use of a marker nucleic acid molecule or a marker protein that is genetically linked to (i.e., a polynucleotide that co-segregates with) such polymorphism(s).

In an alternative embodiment, such polymorphisms can be detected through the use of a marker nucleic acid molecule that is physically linked to such polymorphism(s). For this purpose, marker nucleic acid molecules comprising a nucleotide sequence of a polynucleotide located within 1 mb of the polymorphism(s) and more preferably within 100 kb of the polymorphism(s) and most preferably within 10 kb of the polymorphism(s) can be employed.

The genomes of animals and plants naturally undergo spontaneous mutation in the course of their continuing evolution (Gusella, *Ann. Rev. Biochem.* 55:831-854 (1986)). A "polymorphism" is a variation or difference in the sequence of the gene or its flanking regions that arises in some of the members of a species. The variant sequence and the "original" sequence co-exist in the species' population. In some instances, such co-existence is in stable or quasi-stable equilibrium.

A polymorphism is thus said to be "allelic," in that, due to the existence of the polymorphism, some members of a species may have the original sequence (i.e., the original "allele") whereas other members may have the variant sequence (i.e., the variant "allele"). In the simplest case, only one variant sequence may exist and the polymorphism is thus said to be di-allelic. In other cases, the species' population may contain multiple alleles and the polymorphism is termed tri-allelic, etc. A single gene may have multiple different unrelated polymorphisms. For example, it may have a di-allelic polymorphism at one site and a multi-allelic polymorphism at another site.

The variation that defines the polymorphism may range from a single nucleotide variation to the insertion or deletion of extended regions within a gene. In some cases, the DNA sequence variations are in regions of the genome that are characterized by short tandem repeats (STRs) that include tandem di- or tri-nucleotide repeated motifs of nucleotides. Polymorphisms characterized by such tandem repeats are referred to as "variable number tandem repeat" ("VNTR") polymorphisms. VNTRs have been used in identity analysis (Weber, U.S. Pat. No. 5,075,217; Armour et al., *FEBS Lett.* 307:113-115 (1992); Jones et al., *Eur. J. Haematol.* 39:144-147 (1987); Horn et al., PCT Patent Application WO91/14003; Jeffreys, European Patent Application 370,719; Jeffreys, U.S. Pat. No. 5,175,082; Jeffreys et al., *Amer. J. Hum. Genet.* 39:11-24 (1986); Jeffreys et al., *Nature* 316:76-79 (1985); Gray et al., *Proc. R. Acad. Soc. Lond.* 243:241-253 (1991); Moore et al., *Genomics* 10:654-660 (1991); Jeffreys et al., *Anim. Genet.* 18:1-15 (1987); Hillel et al., *Anim. Genet.* 20:145-155 (1989); Hillel et al., *Genet.* 124:783-789 (1990), all of which are herein incorporated by reference in their entirety).

The detection of polymorphic sites in a sample of DNA may be facilitated through the use of nucleic acid amplification methods. Such methods specifically increase the concentration of polynucleotides that span the polymorphic site, or include that site and sequences located either distal or proximal to it. Such amplified molecules can be readily detected by gel electrophoresis or other means.

The most preferred method of achieving such amplification employs the polymerase chain reaction ("PCR") (Mullis et al., *Cold Spring Harbor Symp. Quant. Biol.* 51:263-273 (1986); Erlich et al., European Patent Appln. 50,424; European Patent Appln. 84,796; European Patent Application 258, 017; European Patent Appln. 237,362; Mullis, European Patent Appln. 201,184; Mullis et al., U.S. Pat. No. 4,683,202; Erlich, U.S. Pat. No. 4,582,788; and Saiki et al., U.S. Pat. No. 4,683,194), using primer pairs that are capable of hybridizing to the proximal sequences that define a polymorphism in its double-stranded form.

In lieu of PCR, alternative methods, such as the "Ligase Chain Reaction" ("LCR") may be used (Barany, *Proc. Natl. Acad. Sci.* (*U.S.A.*) 88:189-193 (1991), the entirety of which is herein incorporated by reference). LCR uses two pairs of oligonucleotide probes to exponentially amplify a specific target. The sequences of each pair of oligonucleotides is selected to permit the pair to hybridize to abutting sequences of the same strand of the target. Such hybridization forms a substrate for a template-dependent ligase. As with PCR, the resulting products thus serve as a template in subsequent cycles and an exponential amplification of the desired sequence is obtained.

LCR can be performed with oligonucleotides having the proximal and distal sequences of the same strand of a polymorphic site. In one embodiment, either oligonucleotide will be designed to include the actual polymorphic site of the polymorphism. In such an embodiment, the reaction conditions are selected such that the oligonucleotides can be ligated together only if the target molecule either contains or lacks the specific nucleotide that is complementary to the polymorphic site present on the oligonucleotide. Alternatively, the oligonucleotides may be selected such that they do not include the polymorphic site (see, Segev, PCT Application WO 90/01069, the entirety of which is herein incorporated by reference).

The "Oligonucleotide Ligation Assay" ("OLA") may alternatively be employed (Landegren et al., *Science* 241:1077-1080 (1988), the entirety of which is herein incorporated by reference). The OLA protocol uses two oligonucleotides which are designed to be capable of hybridizing to abutting sequences of a single strand of a target. OLA, like LCR, is particularly suited for the detection of point mutations. Unlike LCR, however, OLA results in "linear" rather than exponential amplification of the target sequence.

Nickerson et al., have described a nucleic acid detection assay that combines attributes of PCR and OLA (Nickerson et al., *Proc. Natl. Acad. Sci.* (*U.S.A.*) 87:8923-8927 (1990), the entirety of which is herein incorporated by reference). In this method, PCR is used to achieve the exponential amplification of target DNA, which is then detected using OLA. In addition to requiring multiple and separate, processing steps, one problem associated with such combinations is that they inherit all of the problems associated with PCR and OLA.

Schemes based on ligation of two (or more) oligonucleotides in the presence of nucleic acid having the sequence of the resulting "di-oligonucleotide", thereby amplifying the di-oligonucleotide, are also known (Wu et al., *Genomics* 4:560-569 (1989), the entirety of which is herein incorporated by reference) and may be readily adapted to the purposes of the present invention.

Other known nucleic acid amplification procedures, such as allele-specific oligomers, branched DNA technology, transcription-based amplification systems, or isothermal amplification methods may also be used to amplify and analyze such polymorphisms (Malek et al., U.S. Pat. No. 5,130,238; Davey et al., European Patent Application 329,822; Schuster et al., U.S. Pat. No. 5,169,766; Miller et al., PCT Patent Application WO 89/06700; Kwoh et al., *Proc. Natl. Acad. Sci.* (*U.S.A.*) 86:1173-1177 (1989); Gingeras et al., PCT Patent Application WO 88/10315; Walker et al., *Proc. Natl. Acad. Sci.* (*U.S.A.*) 89:392-396 (1992), all of which are herein incorporated by reference in their entirety).

The identification of a polymorphism can be determined in a variety of ways. By correlating the presence or absence of it in a plant with the presence or absence of a phenotype, it is possible to predict the phenotype of that plant. If a polymorphism creates or destroys a restriction endonuclease cleavage site, or if it results in the loss or insertion of DNA (e.g., a VNTR polymorphism), it will alter the size or profile of the DNA fragments that are generated by digestion with that restriction endonuclease. As such, individuals that possess a variant sequence can be distinguished from those having the original sequence by restriction fragment analysis. Polymorphisms that can be identified in this manner are termed "restriction fragment length polymorphisms" ("RFLPs"). RFLPs have been widely used in human and plant genetic analyses (Glassberg, UK Patent Application 2135774; Skolnick et al., *Cytogen. Cell Genet.* 32:58-67 (1982); Botstein et al., *Ann. J. Hum. Genet.* 32:314-331 (1980); Fischer et al., (PCT Application WO90/13668); Uhlen, PCT Application WO90/11369).

Polymorphisms can also be identified by Single Strand Conformation Polymorphism (SSCP) analysis. SSCP is a method capable of identifying most sequence variations in a single strand of DNA, typically between 150 and 250 nucleotides in length (Elles, *Methods in Molecular Medicine Molecular Diagnosis of Genetic Diseases*, Humana Press (1996), the entirety of which is herein incorporated by reference); Orita et al., *Genomics* 5:874-879 (1989), the entirety of which is herein incorporated by reference). Under denaturing conditions a single strand of DNA will adopt a conformation that is uniquely dependent on its sequence conformation. This conformation usually will be different, even if only a single base is changed. Most conformations have been reported to alter the physical configuration or size sufficiently to be detectable by electrophoresis. A number of protocols have been described for SSCP including, but not limited to, Lee et al., *Anal. Biochem.* 205:289-293 (1992), the entirety of which is herein incorporated by reference; Suzuki et al., *Anal. Biochem.* 192:82-84 (1991), the entirety of which is herein incorporated by reference; Lo et al., *Nucleic Acids Research* 20:1005-1009 (1992), the entirety of which is herein incorporated by reference; Sarkar et al., *Genomics* 13:441-443 (1992), the entirety of which is herein incorporated by reference. It is understood that one or more of the nucleic acids of the present invention, may be utilized as markers or probes to detect polymorphisms by SSCP analysis.

Polymorphisms may also be found using a DNA fingerprinting technique called amplified fragment length polymorphism (AFLP), which is based on the selective PCR amplification of restriction fragments from a total digest of genomic DNA to profile that DNA (Vos et al., *Nucleic Acids Res.* 23:4407-4414 (1995), the entirety of which is herein incorporated by reference). This method allows for the specific co-amplification of high numbers of restriction fragments, which can be visualized by PCR without knowledge of the nucleic acid sequence.

AFLP employs basically three steps. Initially, a sample of genomic DNA is cut with restriction enzymes and oligonucleotide adapters are ligated to the restriction fragments of the DNA. The restriction fragments are then amplified using PCR by using the adapter and restriction sequence as target sites for primer annealing. The selective amplification is achieved by the use of primers that extend into the restriction fragments, amplifying only those fragments in which the primer extensions match the nucleotide flanking the restriction sites. These amplified fragments are then visualized on a denaturing polyacrylamide gel.

AFLP analysis has been performed on *Salix* (Beismann et al., *Mol. Ecol.* 6:989-993 (1997), the entirety of which is herein incorporated by reference), *Acinetobacter* (Janssen et al., *Int. J. Syst. Bacteriol.* 47:1179-1187 (1997), the entirety of which is herein incorporated by reference), *Aeromonas popoffi* (Huys et al., *Int. J. Syst. Bacteriol.* 47:1165-1171 (1997), the entirety of which is herein incorporated by reference), rice (McCouch et al., *Plant Mol. Biol.* 35:89-99 (1997), the entirety of which is herein incorporated by reference; Nandi et al., *Mol. Gen. Genet.* 255:1-8 (1997), the entirety of which is herein incorporated by reference; Cho et al., *Genome* 39:373-378 (1996), the entirety of which is herein incorporated by reference), barley (*Hordeum vulgare*) (Simons et al., *Genomics* 44:61-70 (1997), the entirety of which is herein incorporated by reference; Waugh et al., *Mol. Gen. Genet.* 255:311-321 (1997), the entirety of which is herein incorporated by reference; Qi et al., *Mol. Gen. Genet.* 254:330-336 (1997), the entirety of which is herein incorporated by reference; Becker et al., *Mol. Gen. Genet.* 249:65-73 (1995), the entirety of which is herein incorporated by reference), potato (Van der Voort et al., *Mol. Gen. Genet.* 255:438-447 (1997), the entirety of which is herein incorporated by reference; Meksem et al., *Mol. Gen. Genet.* 249:74-81 (1995), the entirety of which is herein incorporated by reference), *Phytophthora infestans* (Van der Lee et al., *Fungal Genet. Biol.* 21:278-291 (1997), the entirety of which is herein incorporated by reference), *Bacillus anthracis* (Keim et al., *J. Bacteriol.* 179:818-824 (1997), the entirety of which is herein incorporated by reference), *Astragalus cremnophylax* (Travis et al., *Mol. Ecol.* 5:735-745 (1996), the entirety of which is herein incorporated by reference), *Arabidopsis* (Cnops et al., *Mol. Gen. Genet.* 253:32-41 (1996), the entirety of which is herein incorporated by reference), *Escherichia coli* (Lin et al., *Nucleic Acids Res.* 24:3649-3650 (1996), the entirety of which is herein incorporated by reference), *Aeromonas* (Huys et al., *Int. J. Syst. Bacteriol.* 46:572-580 (1996), the entirety of which is herein incorporated by reference), nematode (Folkertsma et al., *Mol. Plant Microbe Interact.* 9:47-54 (1996), the entirety of which is herein incorporated by reference), tomato (Thomas et al., *Plant J.* 8:785-794 (1995), the entirety of which is herein incorporated by reference) and human (Latorra et al., *PCR Methods Appl.* 3:351-358 (1994), the entirety of which is herein incorporated by reference). AFLP analysis has also been used for fingerprinting mRNA (Money et al., *Nucleic Acids Res.* 24:2616-2617 (1996), the entirety of which is herein incorporated by reference; Bachem et al., *Plant J.* 9:745-753 (1996), the entirety of which is herein incorporated by reference). It is understood that one or more of the nucleic acids of the present invention, may be utilized as markers or probes to detect polymorphisms by AFLP analysis or for fingerprinting RNA.

Polymorphisms may also be found using random amplified polymorphic DNA (RAPD) (Williams et al., *Nucl. Acids Res.* 18:6531-6535 (1990), the entirety of which is herein incorporated by reference) and cleaveable amplified polymorphic sequences (CAPS) (Lyamichev et al., *Science* 260:778-783 (1993), the entirety of which is herein incorporated by reference). It is understood that one or more of the nucleic acid molecules of the present invention, may be utilized as markers or probes to detect polymorphisms by RAPD or CAPS analysis.

Through genetic mapping, a fine scale linkage map can be developed using DNA markers and, then, a genomic DNA library of large-sized fragments can be screened with molecular markers linked to the desired trait. Molecular markers are advantageous for agronomic traits that are otherwise difficult to tag, such as resistance to pathogens, insects and nematodes, tolerance to abiotic stress, quality parameters and quantitative traits such as high yield potential.

The essential requirements for marker-assisted selection in a plant breeding program are: (1) the marker(s) should co-segregate or be closely linked with the desired trait; (2) an efficient means of screening large populations for the molecular marker(s) should be available; and (3) the screening technique should have high reproducibility across laboratories and preferably be economical to use and be user-friendly.

The genetic linkage of marker molecules can be established by a gene mapping model such as, without limitation, the flanking marker model reported by Lander and Botstein, *Genetics* 121:185-199 (1989) and the interval mapping, based on maximum likelihood methods described by Lander and Botstein, *Genetics* 121:185-199 (1989) and implemented in the software package MAPMAKER/QTL (Lincoln and Lander, *Mapping Genes Controlling Quantitative Traits Using MAPMAKER/QTL*, Whitehead Institute for Biomedical Research, Massachusetts, (1990). Additional software includes Qgene, Version 2.23 (1996), Department of Plant Breeding and Biometry, 266 Emerson Hall, Cornell University, Ithaca, N.Y., the manual of which is herein incorporated by reference in its entirety). Use of Qgene software is a particularly preferred approach.

A maximum likelihood estimate (MLE) for the presence of a marker is calculated, together with an MLE assuming no QTL effect, to avoid false positives. A $\log_{10}$ of an odds ratio (LOD) is then calculated as: LOD=$\log_{10}$ (MLE for the presence of a QTL/MLE given no linked QTL).

The LOD score essentially indicates how much more likely the data are to have arisen assuming the presence of a QTL than in its absence. The LOD threshold value for avoiding a false positive with a given confidence, say 95%, depends on the number of markers and the length of the genome. Graphs indicating LOD thresholds are set forth in Lander and Botstein, *Genetics* 121:185-199 (1989) the entirety of which is herein incorporated by reference and further described by Arús and Moreno-González, *Plant Breeding*, Hayward et al., (eds.) Chapman & Hall, London, pp. 314-331 (1993), the entirety of which is herein incorporated by reference.

Additional models can be used. Many modifications and alternative approaches to interval mapping have been reported, including the use non-parametric methods (Kruglyak and Lander, *Genetics* 139:1421-1428 (1995), the entirety of which is herein incorporated by reference). Multiple regression methods or models can be also be used, in which the trait is regressed on a large number of markers (Jansen, *Biometrics in Plant Breeding*, van Oijen and Jansen (eds.), Proceedings of the Ninth Meeting of the Eucarpia Section Biometrics in Plant Breeding, The Netherlands, pp. 116-124 (1994); Weber and Wricke, *Advances in Plant Breeding*, Blackwell, Berlin, 16 (1994), both of which is herein incorporated by reference in their entirety). Procedures combining interval mapping with regression analysis, whereby the phenotype is regressed onto a single putative QTL at a given marker interval and at the same time onto a number of markers that serve as 'cofactors,' have been reported by Jansen and Stam, *Genetics* 136:1447-1455 (1994), the entirety of which is herein incorporated by reference and Zeng, *Genetics* 136:1457-1468 (1994) the entirety of which is herein incorporated by reference. Generally, the use of cofactors reduces the bias and sampling error of the estimated QTL positions (Utz and Melchinger, *Biometrics in Plant Breeding*, van Oijen and Jansen (eds.) Proceedings of the Ninth Meeting of the Eucarpia Section Biometrics in Plant Breeding, The Netherlands, pp. 195-204 (1994), the entirety of which is herein incorporated by reference, thereby improving the precision and efficiency of QTL mapping (Zeng, *Genetics* 136:1457-1468 (1994)). These models can be extended to multi-environment experiments to analyze genotype-environment interactions (Jansen et al., *Theo. Appl. Genet.* 91:33-37 (1995), the entirety of which is herein incorporated by reference).

Selection of an appropriate mapping populations is important to map construction. The choice of appropriate mapping population depends on the type of marker systems employed (Tanksley et al., *Molecular mapping plant chromosomes. Chromosome structure and function: Impact of new concepts*, Gustafson and Appels (eds.), Plenum Press, New York, pp 157-173 (1988), the entirety of which is herein incorporated by reference). Consideration must be given to the source of parents (adapted vs. exotic) used in the mapping population. Chromosome pairing and recombination rates can be severely disturbed (suppressed) in wide crosses (adapted×exotic) and generally yield greatly reduced linkage distances. Wide crosses will usually provide segregating populations with a relatively large array of polymorphisms when compared to progeny in a narrow cross (adapted×adapted).

An $F_2$ population is the first generation of selfing after the hybrid seed is produced. Usually a single $F_1$ plant is selfed to generate a population segregating for all the genes in Mendelian (1:2:1) fashion. Maximum genetic information is obtained from a completely classified $F_2$ population using a codominant marker system (Mather, *Measurement of Linkage in Heredity*, Methuen and Co., (1938), the entirety of which is herein incorporated by reference). In the case of dominant markers, progeny tests (e.g. $F_3$, $BCF_2$) are required to identify the heterozygotes, thus making it equivalent to a completely classified $F_2$ population. However, this procedure is often prohibitive because of the cost and time involved in progeny testing. Progeny testing of $F_2$ individuals is often used in map construction where phenotypes do not consistently reflect genotype (e.g. disease resistance) or where trait expression is controlled by a QTL. Segregation data from progeny test populations (e.g. $F_3$ or $BCF_2$) can be used in map construction. Marker-assisted selection can then be applied to cross progeny based on marker-trait map associations ($F_2$, $F_3$), where linkage groups have not been completely disassociated by recombination events (i.e., maximum disequillibrium).

Recombinant inbred lines (RIL) (genetically related lines; usually $>F_5$, developed from continuously selfing $F_2$ lines towards homozygosity) can be used as a mapping population. Information obtained from dominant markers can be maximized by using RIL because all loci are homozygous or nearly so. Under conditions of tight linkage (i.e., about <10% recombination), dominant and co-dominant markers evaluated in RIL populations provide more information per individual than either marker type in backcross populations (Reiter et al., *Proc. Natl. Acad. Sci. (U.S.A.)* 89:1477-1481 (1992), the entirety of which is herein incorporated by reference). However, as the distance between markers becomes larger (i.e., loci become more independent), the information in RIL populations decreases dramatically when compared to codominant markers.

Backcross populations (e.g., generated from a cross between a successful variety (recurrent parent) and another variety (donor parent) carrying a trait not present in the former) can be utilized as a mapping population. A series of backcrosses to the recurrent parent can be made to recover most of its desirable traits. Thus a population is created consisting of individuals nearly like the recurrent parent but each individual carries varying amounts or mosaic of genomic regions from the donor parent. Backcross populations can be useful for mapping dominant markers if all loci in the recurrent parent are homozygous and the donor and recurrent parent have contrasting polymorphic marker alleles (Reiter et al., *Proc. Natl. Acad. Sci. (U.S.A.)* 89:1477-1481 (1992)). Information obtained from backcross populations using either codominant or dominant markers is less than that obtained from $F_2$ populations because one, rather than two, recombinant gametes are sampled per plant. Backcross populations, however, are more informative (at low marker saturation) when compared to RILs as the distance between linked loci increases in RIL populations (i.e. about 15% recombination). Increased recombination can be beneficial for resolution of tight linkages, but may be undesirable in the construction of maps with low marker saturation.

Near-isogenic lines (NIL) created by many backcrosses to produce an array of individuals that are nearly identical in genetic composition except for the trait or genomic region under interrogation can be used as a mapping population. In mapping with NILs, only a portion of the polymorphic loci are expected to map to a selected region.

Bulk segregant analysis (BSA) is a method developed for the rapid identification of linkage between markers and traits of interest (Michelmore et al., *Proc. Natl. Acad. Sci.* (*U.S.A.*) 88:9828-9832 (1991), the entirety of which is herein incorporated by reference). In BSA, two bulked DNA samples are drawn from a segregating population originating from a single cross. These bulks contain individuals that are identical for a particular trait (resistant or susceptible to particular disease) or genomic region but arbitrary at unlinked regions (i.e. heterozygous). Regions unlinked to the target region will not differ between the bulked samples of many individuals in BSA.

It is understood that one or more of the nucleic acid molecules of the present invention may be used as molecular markers. It is also understood that one or more of the protein molecules of the present invention may be used as molecular markers.

In accordance with this aspect of the present invention, a sample nucleic acid is obtained from plants cells or tissues. Any source of nucleic acid may be used. Preferably, the nucleic acid is genomic DNA. The nucleic acid is subjected to restriction endonuclease digestion. For example, one or more nucleic acid molecule or fragment thereof of the present invention can be used as a probe in accordance with the above-described polymorphic methods. The polymorphism obtained in this approach can then be cloned to identify the mutation at the coding region which alters the protein's structure or regulatory region of the gene which affects its expression level.

In an aspect of the present invention, one or more of the nucleic molecules of the present invention are used to determine the level (i.e., the concentration of mRNA in a sample, etc.) in a plant (preferably maize or soybean) or pattern (i.e., the kinetics of expression, rate of decomposition, stability profile, etc.) of the expression of a protein encoded in part or whole by one or more of the nucleic acid molecule of the present invention (collectively, the "Expression Response" of a cell or tissue). As used herein, the Expression Response manifested by a cell or tissue is said to be "altered" if it differs from the Expression Response of cells or tissues of plants not exhibiting the phenotype. To determine whether a Expression Response is altered, the Expression Response manifested by the cell or tissue of the plant exhibiting the phenotype is compared with that of a similar cell or tissue sample of a plant not exhibiting the phenotype. As will be appreciated, it is not necessary to re-determine the Expression Response of the cell or tissue sample of plants not exhibiting the phenotype each time such a comparison is made; rather, the Expression Response of a particular plant may be compared with previously obtained values of normal plants. As used herein, the phenotype of the organism is any of one or more characteristics of an organism (e.g. disease resistance, pest tolerance, environmental tolerance such as tolerance to abiotic stress, male sterility, quality improvement or yield etc.). A change in genotype or phenotype may be transient or permanent. Also as used herein, a tissue sample is any sample that comprises more than one cell. In a preferred aspect, a tissue sample comprises cells that share a common characteristic (e.g. derived from root, seed, flower, leaf, stem or pollen etc.).

In one aspect of the present invention, an evaluation can be conducted to determine whether a particular mRNA molecule is present. One or more of the nucleic acid molecules of the present invention, preferably one or more of the EST nucleic acid molecules or fragments thereof of the present invention are utilized to detect the presence or quantity of the mRNA species. Such molecules are then incubated with cell or tissue extracts of a plant under conditions sufficient to permit nucleic acid hybridization. The detection of double-stranded probe-mRNA hybrid molecules is indicative of the presence of the mRNA; the amount of such hybrid formed is proportional to the amount of mRNA. Thus, such probes may be used to ascertain the level and extent of the mRNA production in a plant's cells or tissues. Such nucleic acid hybridization may be conducted under quantitative conditions (thereby providing a numerical value of the amount of the mRNA present). Alternatively, the assay may be conducted as a qualitative assay that indicates either that the mRNA is present, or that its level exceeds a user set, predefined value.

A principle of in situ hybridization is that a labeled, single-stranded nucleic acid probe will hybridize to a complementary strand of cellular DNA or RNA and, under the appropriate conditions, these molecules will form a stable hybrid. When nucleic acid hybridization is combined with histological techniques, specific DNA or RNA sequences can be identified within a single cell. An advantage of in situ hybridization over more conventional techniques for the detection of nucleic acids is that it allows an investigator to determine the precise spatial population (Angerer et al., *Dev. Biol.* 101:477-484 (1984), the entirety of which is herein incorporated by reference; Angerer et al., *Dev. Biol.* 112:157-166 (1985), the entirety of which is herein incorporated by reference; Dixon et al., *EMBO J.* 10:1317-1324 (1991), the entirety of which is herein incorporated by reference). In situ hybridization may be used to measure the steady-state level of RNA accumulation. It is a sensitive technique and RNA sequences present in as few as 5-10 copies per cell can be detected (Hardin et al., *J. Mol. Biol.* 202:417-431 (1989), the entirety of which is herein incorporated by reference). A number of protocols have been devised for in situ hybridization, each with tissue preparation, hybridization and washing conditions (Meyerowitz, *Plant Mol. Biol. Rep.* 5:242-250 (1987), the entirety of which is herein incorporated by reference; Cox and Goldberg, In: *Plant Molecular Biology: A Practical Approach*, Shaw (ed.), pp 1-35, IRL Press, Oxford (1988), the entirety of which is herein incorporated by reference; Raikhel et al., *In situ RNA hybridization in plant tissues*, In: *Plant Molecular Biology Manual*, vol. B9: 1-32, Kluwer Academic Publisher, Dordrecht, Belgium (1989), the entirety of which is herein incorporated by reference).

In situ hybridization also allows for the localization of proteins within a tissue or cell (Wilkinson, *In Situ Hybridization*, Oxford University Press, Oxford (1992), the entirety of which is herein incorporated by reference; Langdale, *In Situ Hybridization In: The Maize Handbook* Freeling and Walbot (eds.), pp 165-179, Springer-Verlag, New York (1994), the entirety of which is herein incorporated by reference). It is understood that one or more of the molecules of the present invention, preferably one or more of the EST nucleic acid molecules or fragments thereof of the present invention or one or more of the antibodies of the present invention may be utilized to detect the level or pattern of a methionine pathway protein or mRNA thereof by in situ hybridization.

Fluorescent in situ hybridization allows the localization of a particular DNA sequence along a chromosome which is useful, among other uses, for gene mapping, following chromosomes in hybrid lines or detecting chromosomes with translocations, transversions or deletions. In situ hybridization has been used to identify chromosomes in several plant species (Griffor et al., *Plant Mol. Biol.* 17:101-109 (1991), the entirety of which is herein incorporated by reference; Gustafson et al., *Proc. Natl. Acad. Sci. (U.S.A.)* 87:1899-1902 (1990), herein incorporated by reference; Mukai and Gill, *Genome* 34:448-452 (1991), the entirety of which is herein incorporated by reference; Schwarzacher and Heslop-Harrison, *Genome* 34:317-323 (1991); Wang et al., *Jpn. J. Genet.* 66:313-316 (1991), the entirety of which is herein incorporated by reference; Parra and Windle, *Nature Genetics* 5:17-21 (1993), the entirety of which is herein incorporated by reference). It is understood that the nucleic acid molecules of the present invention may be used as probes or markers to localize sequences along a chromosome.

Another method to localize the expression of a molecule is tissue printing. Tissue printing provides a way to screen, at the same time on the same membrane many tissue sections from different plants or different developmental stages. Tissue-printing procedures utilize films designed to immobilize proteins and nucleic acids. In essence, a freshly cut section of a tissue is pressed gently onto nitrocellulose paper, nylon membrane or polyvinylidene difluoride membrane. Such membranes are commercially available (e.g. Millipore, Bedford, Mass. U.S.A.). The contents of the cut cell transfer onto the membrane and the contents and are immobilized to the membrane. The immobilized contents form a latent print that can be visualized with appropriate probes. When a plant tissue print is made on nitrocellulose paper, the cell walls leave a physical print that makes the anatomy visible without further treatment (Varner and Taylor, *Plant Physiol.* 91:31-33 (1989), the entirety of which is herein incorporated by reference).

Tissue printing on substrate films is described by Daoust, *Exp. Cell Res.* 12:203-211 (1957), the entirety of which is herein incorporated by reference, who detected amylase, protease, ribonuclease and deoxyribonuclease in animal tissues using starch, gelatin and agar films. These techniques can be applied to plant tissues (Yomo and Taylor, *Planta* 112:35-43 (1973); the entirety of which is herein incorporated by reference; Harris and Chrispeels, *Plant Physiol.* 56:292-299 (1975), the entirety of which is herein incorporated by reference). Advances in membrane technology have increased the range of applications of Daoust's tissue-printing techniques allowing (Cassab and Varner, *J. Cell. Biol.* 105:2581-2588 (1987), the entirety of which is herein incorporated by reference) the histochemical localization of various plant enzymes and deoxyribonuclease on nitrocellulose paper and nylon (Spruce et al., *Phytochemistry* 26:2901-2903 (1987), the entirety of which is herein incorporated by reference; Barres et al., *Neuron* 5:527-544 (1990), the entirety of which is herein incorporated by reference; Reid and Pont-Lezica, *Tissue Printing: Tools for the Study of Anatomy, Histochemistry and Gene Expression*, Academic Press, New York, N.Y. (1992), the entirety of which is herein incorporated by reference; Reid et al., *Plant Physiol.* 93:160-165 (1990), the entirety of which is herein incorporated by reference; Ye et al., *Plant J.* 1:175-183 (1991), the entirety of which is herein incorporated by reference).

It is understood that one or more of the molecules of the present invention, preferably one or more of the EST nucleic acid molecules or fragments thereof of the present invention or one or more of the antibodies of the present invention may be utilized to detect the presence or quantity of a methionine pathway protein by tissue printing.

Further it is also understood that any of the nucleic acid molecules of the present invention may be used as marker nucleic acids and or probes in connection with methods that require probes or marker nucleic acids. As used herein, a probe is an agent that is utilized to determine an attribute or feature (e.g. presence or absence, location, correlation, etc.) of a molecule, cell, tissue or plant. As used herein, a marker nucleic acid is a nucleic acid molecule that is utilized to determine an attribute or feature (e.g., presence or absence, location, correlation, etc.) or a molecule, cell, tissue or plant.

A microarray-based method for high-throughput monitoring of plant gene expression may be utilized to measure gene-specific hybridization targets. This 'chip'-based approach involves using microarrays of nucleic acid molecules as gene-specific hybridization targets to quantitatively measure expression of the corresponding plant genes (Schena et al., *Science* 270:467-470 (1995), the entirety of which is herein incorporated by reference; Shalon, Ph.D. Thesis, Stanford University (1996), the entirety of which is herein incorporated by reference). Every nucleotide in a large sequence can be queried at the same time. Hybridization can be used to efficiently analyze nucleotide sequences.

Several microarray methods have been described. One method compares the sequences to be analyzed by hybridization to a set of oligonucleotides representing all possible subsequences (Bains and Smith, *J. Theor. Biol.* 135:303-307 (1989), the entirety of which is herein incorporated by reference). A second method hybridizes the sample to an array of oligonucleotide or cDNA molecules. An array consisting of oligonucleotides complementary to subsequences of a target sequence can be used to determine the identity of a target sequence, measure its amount and detect differences between the target and a reference sequence. Nucleic acid molecules microarrays may also be screened with protein molecules or fragments thereof to determine nucleic acid molecules that specifically bind protein molecules or fragments thereof.

The microarray approach may be used with polypeptide targets (U.S. Pat. No. 5,445,934; U.S. Pat. No. 5,143,854; U.S. Pat. No. 5,079,600; U.S. Pat. No. 4,923,901, all of which are herein incorporated by reference in their entirety). Essentially, polypeptides are synthesized on a substrate (microarray) and these polypeptides can be screened with either protein molecules or fragments thereof or nucleic acid molecules in order to screen for either protein molecules or fragments thereof or nucleic acid molecules that specifically bind the target polypeptides. (Fodor et al., *Science* 251:767-773 (1991), the entirety of which is herein incorporated by reference). It is understood that one or more of the nucleic acid molecules or protein or fragments thereof of the present invention may be utilized in a microarray based method.

In a preferred embodiment of the present invention microarrays may be prepared that comprise nucleic acid molecules where such nucleic acid molecules encode at least one, preferably at least two, more preferably at least three, even more preferably at least four, five six or seven methionine pathway enzymes. In a preferred embodiment the nucleic acid molecules are selected from the group consisting of a nucleic acid molecule that encodes a maize or a soybean methionine adenosyltransferase enzyme or fragment thereof, a nucleic acid molecule that encodes a maize or a soybean S-adenosylmethionine decarboxylase enzyme or fragment thereof, a nucleic acid molecule that encodes a maize or a soybean aspartate kinase enzyme or fragment thereof, a nucleic acid molecule that encodes a maize or a soybean aspartate-semialdehyde dehydrogenase enzyme or fragment thereof, a nucleic acid molecule that encodes a maize or a soybean O-succinylhomoserine (thiol)-lyase enzyme or fragment thereof, a nucleic acid molecule that encodes a maize or a soybean cystathionine β-lyase enzyme or fragment thereof, a nucleic acid molecule that encodes a maize or a soybean 5-methyltetrahydropteroyltriglutamate-homocysteine-S-methyltransferase enzyme or fragment thereof, a nucleic acid molecule that encodes a maize or a soybean adenosylhomocysteinase enzyme or fragment thereof, a nucleic acid molecule that encodes a maize or a soybean cystathionine β-synthase enzyme or fragment thereof, a nucleic acid molecule that encodes a maize or a soybean cystathionine γ-lyase enzyme or fragment thereof and a nucleic acid molecule that encodes a maize or a soybean O-acetylhomoserine (thiol)-lyase enzyme or fragment thereof.

Site directed mutagenesis may be utilized to modify nucleic acid sequences, particularly as it is a technique that allows one or more of the amino acids encoded by a nucleic acid molecule to be altered (e.g. a threonine to be replaced by a methionine). Three basic methods for site directed mutagenesis are often employed. These are cassette mutagenesis (Wells et al., *Gene* 34:315-323 (1985), the entirety of which is herein incorporated by reference), primer extension (Gilliam et al., *Gene* 12:129-137 (1980), the entirety of which is herein incorporated by reference; Zoller and Smith, *Methods Enzymol.* 100:468-500 (1983), the entirety of which is herein incorporated by reference; Dalbadie-McFarland et al., *Proc. Natl. Acad. Sci. (U.S.A.)* 79:6409-6413 (1982), the entirety of which is herein incorporated by reference) and methods based upon PCR (Scharf et al., *Science* 233:1076-1078 (1986), the entirety of which is herein incorporated by reference; Higuchi et al., *Nucleic Acids Res.* 16:7351-7367 (1988), the entirety of which is herein incorporated by reference). Site directed mutagenesis approaches are also described in European Patent 0 385 962, the entirety of which is herein incorporated by reference; European Patent 0 359 472, the entirety of which is herein incorporated by reference; and PCT Patent Application WO 93/07278, the entirety of which is herein incorporated by reference.

Site directed mutagenesis strategies have been applied to plants for both in vitro as well as in vivo site directed mutagenesis (Lanz et al., *J. Biol. Chem.* 266:9971-9976 (1991), the entirety of which is herein incorporated by reference; Kovgan and Zhdanov, *Biotekhnologiya* 5:148-154, No. 207160n, Chemical Abstracts 110:225 (1989), the entirety of which is herein incorporated by reference; Ge et al., *Proc. Natl. Acad. Sci. (U.S.A.)* 86:4037-4041 (1989), the entirety of which is herein incorporated by reference; Zhu et al., *J. Biol. Chem.* 271:18494-18498 (1996), the entirety of which is herein incorporated by reference; Chu et al., *Biochemistry* 33:6150-6157 (1994), the entirety of which is herein incorporated by reference; Small et al., *EMBO J.* 11:1291-1296 (1992), the entirety of which is herein incorporated by reference; Cho et al., *Mol. Biotechnol.* 8:13-16 (1997), the entirety of which is herein incorporated by reference; Kita et al., *J. Biol. Chem.* 271:26529-26535 (1996), the entirety of which is herein incorporated by reference, Jin et al., *Mol. Microbiol.* 7:555-562 (1993), the entirety of which is herein incorporated by reference; Hatfield and Vierstra, *J. Biol. Chem.* 267:14799-14803 (1992), the entirety of which is herein incorporated by reference; Zhao et al., *Biochemistry* 31:5093-5099 (1992), the entirety of which is herein incorporated by reference).

Any of the nucleic acid molecules of the present invention may either be modified by site directed mutagenesis or used as, for example, nucleic acid molecules that are used to target other nucleic acid molecules for modification. It is understood that mutants with more than one altered nucleotide can be constructed using techniques that practitioners are familiar with such as isolating restriction fragments and ligating such fragments into an expression vector (see, for example, Sambrook et al., *Molecular Cloning: A Laboratory Manual*, Cold Spring Harbor Press (1989)).

Sequence-specific DNA-binding proteins play a role in the regulation of transcription. The isolation of recombinant cDNAs encoding these proteins facilitates the biochemical analysis of their structural and functional properties. Genes encoding such DNA-binding proteins have been isolated using classical genetics (Vollbrecht et al., *Nature* 350: 241-243 (1991), the entirety of which is herein incorporated by reference) and molecular biochemical approaches, including the screening of recombinant cDNA libraries with antibodies (Landschulz et al., *Genes Dev.* 2:786-800 (1988), the entirety of which is herein incorporated by reference) or DNA probes (Bodner et al., *Cell* 55:505-518 (1988), the entirety of which is herein incorporated by reference). In addition, an in situ screening procedure has been used and has facilitated the isolation of sequence-specific DNA-binding proteins from various plant species (Gilmartin et al., *Plant Cell* 4:839-849 (1992), the entirety of which is herein incorporated by reference; Schindler et al., *EMBO J.* 11:1261-1273 (1992), the entirety of which is herein incorporated by reference). An in situ screening protocol does not require the purification of the protein of interest (Vinson et al., *Genes Dev.* 2:801-806 (1988), the entirety of which is herein incorporated by reference; Singh et al., *Cell* 52:415-423 (1988), the entirety of which is herein incorporated by reference).

Two steps may be employed to characterize DNA-protein interactions. The first is to identify promoter fragments that interact with DNA-binding proteins, to titrate binding activity, to determine the specificity of binding and to determine whether a given DNA-binding activity can interact with related DNA sequences (Sambrook et al., *Molecular Cloning: A Laboratory Manual, 2$^{nd}$* edition, Cold Spring Harbor Laboratory Press, Cold Spring Harbor, N.Y. (1989)). Electrophoretic mobility-shift assay is a widely used assay. The assay provides a rapid and sensitive method for detecting DNA-binding proteins based on the observation that the mobility of a DNA fragment through a nondenaturing, low-ionic strength polyacrylamide gel is retarded upon association with a DNA-binding protein (Fried and Crother, *Nucleic Acids Res.* 9:6505-6525 (1981), the entirety of which is herein incorporated by reference). When one or more specific binding activities have been identified, the exact sequence of the DNA bound by the protein may be determined. Several procedures for characterizing protein/DNA-binding sites are used, including methylation and ethylation interference assays (Maxam and Gilbert, *Methods Enzymol.* 65:499-560 (1980), the entirety of which is herein incorporated by reference; Wissman and Hillen, *Methods Enzymol.* 208:365-379 (1991), the entirety of which is herein incorporated by reference), footprinting techniques employing DNase I (Galas and Schmitz, *Nucleic Acids Res.* 5:3157-3170 (1978), the entirety of which is herein incorporated by reference), 1,10-phenanthroline-copper ion methods (Sigman et al., *Methods Enzymol.* 208:414-433 (1991), the entirety of which is herein incorporated by reference) and hydroxyl radicals methods (Dixon et al., *Methods Enzymol.* 208:414-433 (1991), the entirety of which is herein incorporated by reference). It is understood that one or more of the nucleic acid molecules of the present invention may be utilized to identify a protein or fragment thereof that specifically binds to a nucleic acid molecule of the present invention. It is also understood that one or more of the protein molecules or fragments thereof of the present invention may be utilized to identify a nucleic acid molecule that specifically binds to it.

A two-hybrid system is based on the fact that many cellular functions are carried out by proteins, such as transcription factors, that interact (physically) with one another. Two-hybrid systems have been used to probe the function of new proteins (Chien et al., *Proc. Natl. Acad. Sci. (U.S.A.)* 88:9578-9582 (1991) the entirety of which is herein incorporated by reference; Durfee et al., *Genes Dev.* 7:555-569 (1993) the entirety of which is herein incorporated by reference; Choi et al., *Cell* 78:499-512 (1994), the entirety of which is herein incorporated by reference; Kranz et al., *Genes Dev.* 8:313-327 (1994), the entirety of which is herein incorporated by reference).

Interaction mating techniques have facilitated a number of two-hybrid studies of protein-protein interaction. Interaction mating has been used to examine interactions between small sets of tens of proteins (Finley and Brent, *Proc. Natl. Acad. Sci. (U.S.A.)* 91:12098-12984 (1994), the entirety of which is herein incorporated by reference), larger sets of hundreds of proteins (Bendixen et al., *Nucl. Acids Res.* 22:1778-1779 (1994), the entirety of which is herein incorporated by reference) and to comprehensively map proteins encoded by a small genome (Bartel et al., *Nature Genetics* 12:72-77 (1996), the entirety of which is herein incorporated by reference). This technique utilizes proteins fused to the DNA-binding domain and proteins fused to the activation domain. They are expressed in two different haploid yeast strains of opposite mating type and the strains are mated to determine if the two proteins interact. Mating occurs when haploid yeast strains come into contact and result in the fusion of the two haploids into a diploid yeast strain. An interaction can be determined by the activation of a two-hybrid reporter gene in the diploid strain. An advantage of this technique is that it reduces the number of yeast transformations needed to test individual interactions. It is understood that the protein-protein interactions of protein or fragments thereof of the present invention may be investigated using the two-hybrid system and that any of the nucleic acid molecules of the present invention that encode such proteins or fragments thereof may be used to transform yeast in the two-hybrid system.

(a) Plant Constructs and Plant Transformants

One or more of the nucleic acid molecules of the present invention may be used in plant transformation or transfection. Exogenous genetic material may be transferred into a plant cell and the plant cell regenerated into a whole, fertile or sterile plant. Exogenous genetic material is any genetic material, whether naturally occurring or otherwise, from any source that is capable of being inserted into any organism. Such genetic material may be transferred into either monocotyledons and dicotyledons including, but not limited to maize (pp 63-69), soybean (pp 50-60), *Arabidopsis* (p 45), *phaseolus* (pp 47-49), peanut (pp 49-50), alfalfa (p 60), wheat (pp 69-71), rice (pp 72-79), oat (pp 80-81), sorghum (p 83), rye (p 84), tritordeum (p 84), millet (p 85), fescue (p 85), perennial ryegrass (p 86), sugarcane (p 87), cranberry (p 110), papaya (pp 101-102), banana (p 103), banana (p 103), muskmelon (p 104), apple (p 104), cucumber (p 105), dendrobium (p 109), gladiolus (p 110), chrysanthemum (p 110), liliacea (p 111), cotton (pp 113-114), eucalyptus (p 115), sunflower (p 118), canola (p 118), turfgrass (p 121), sugarbeet (p 122), coffee (p 122) and dioscorea (p 122), (Christou, In: *Particle Bombardment for Genetic Engineering of Plants*, Biotechnology Intelligence Unit. Academic Press, San Diego, Calif. (1996), the entirety of which is herein incorporated by reference).

Transfer of a nucleic acid that encodes for a protein can result in overexpression of that protein in a transformed cell or transgenic plant. One or more of the proteins or fragments thereof encoded by nucleic acid molecules of the present invention may be overexpressed in a transformed cell or transformed plant. Particularly, any of the methionine pathway proteins or fragments thereof may be overexpressed in a transformed cell or transgenic plant. Such overexpression may be the result of transient or stable transfer of the exogenous genetic material.

Exogenous genetic material may be transferred into a plant cell and the plant cell by the use of a DNA vector or construct designed for such a purpose. Design of such a vector is generally within the skill of the art (See, *Plant Molecular Biology: A Laboratory Manual*, Clark (ed.), Springier, N.Y. (1997), the entirety of which is herein incorporated by reference).

A construct or vector may include a plant promoter to express the protein or protein fragment of choice. A number of promoters which are active in plant cells have been described in the literature. These include the nopaline synthase (NOS) promoter (Ebert et al., *Proc. Natl. Acad. Sci. (U.S.A.)* 84:5745-5749 (1987), the entirety of which is herein incorporated by reference), the octopine synthase (OCS) promoter (which are carried on tumor-inducing plasmids of *Agrobacterium tumefaciens*), the caulimovirus promoters such as the cauliflower mosaic virus (CaMV) 19S promoter (Lawton et al., *Plant Mol. Biol.* 9:315-324 (1987), the entirety of which is herein incorporated by reference) and the CAMV 35S promoter (Odell et al., *Nature* 313:810-812 (1985), the entirety of which is herein incorporated by reference), the figwort mosaic virus 35S-promoter, the light-inducible promoter from the small subunit of ribulose-1,5-bis-phosphate carboxylase (ssRUBISCO), the Adh promoter (Walker et al., *Proc. Natl. Acad. Sci. (U.S.A.)* 84:6624-6628 (1987), the entirety of which is herein incorporated by reference), the sucrose synthase promoter (Yang et al., *Proc. Natl. Acad. Sci. (U.S.A.)* 87:4144-4148 (1990), the entirety of which is herein incorporated by reference), the R gene complex promoter (Chandler et al., *The Plant Cell* 1:1175-1183 (1989), the entirety of which is herein incorporated by reference) and the chlorophyll a/b binding protein gene promoter, etc. These promoters have been used to create DNA constructs which have been expressed in plants; see, e.g., PCT publication WO 84/02913, herein incorporated by reference in its entirety.

Promoters which are known or are found to cause transcription of DNA in plant cells can be used in the present invention. Such promoters may be obtained from a variety of sources such as plants and plant viruses. It is preferred that the particular promoter selected should be capable of causing sufficient expression to result in the production of an effective amount of the methionine pathway protein to cause the desired phenotype. In addition to promoters that are known to cause transcription of DNA in plant cells, other promoters may be identified for use in the current invention by screening a plant cDNA library for genes which are selectively or preferably expressed in the target tissues or cells.

For the purpose of expression in source tissues of the plant, such as the leaf, seed, root or stem, it is preferred that the promoters utilized in the present invention have relatively high expression in these specific tissues. For this purpose, one may choose from a number of promoters for genes with tissue- or cell-specific or -enhanced expression. Examples of such promoters reported in the literature include the chloroplast glutamine synthetase GS2 promoter from pea (Edwards et al., *Proc. Natl. Acad. Sci. (U.S.A.)* 87:3459-3463 (1990), herein incorporated by reference in its entirety), the chloroplast fructose-1,6-biphosphatase (FBPase) promoter from wheat (Lloyd et al., *Mol. Gen. Genet.* 225:209-216 (1991), herein incorporated by reference in its entirety), the nuclear photosynthetic ST-LS1 promoter from potato (Stockhaus et al., *EMBO J.* 8:2445-2451 (1989), herein incorporated by reference in its entirety), the serine/threonine kinase (PAL) promoter and the glucoamylase (CHS) promoter from *Ara-* bidopsis thaliana. Also reported to be active in photosynthetically active tissues are the ribulose-1,5-bisphosphate carboxylase (RbcS) promoter from eastern larch (*Larix laricina*), the promoter for the cab gene, cab6, from pine (Yamamoto et al., *Plant Cell Physiol.* 35:773-778 (1994), herein incorporated by reference in its entirety), the promoter for the Cab-1 gene from wheat (Fejes et al., *Plant Mol. Biol.* 15:921-932 (1990), herein incorporated by reference in its entirety), the promoter for the CAB-1 gene from spinach (Lubberstedt et al., *Plant Physiol.* 104:997-1006 (1994), herein incorporated by reference in its entirety), the promoter for the cab1R gene from rice (Luan et al., *Plant Cell.* 4:971-981 (1992), the entirety of which is herein incorporated by reference), the pyruvate, orthophosphate dikinase (PPDK) promoter from maize (Matsuoka et al., *Proc. Natl. Acad. Sci. (U.S.A.)* 90: 9586-9590 (1993), herein incorporated by reference in its entirety), the promoter for the tobacco Lhcb1*2 gene (Cerdan et al., *Plant Mol. Biol.* 33:245-255 (1997), herein incorporated by reference in its entirety), the *Arabidopsis thaliana* SUC2 sucrose-H+ symporter promoter (Truernit et al., *Planta.* 196:564-570 (1995), herein incorporated by reference in its entirety) and the promoter for the thylakoid membrane proteins from spinach (psaD, psaF, psaE, PC, FNR, atpC, atpD, cab, rbcS). Other promoters for the chlorophyll a/b-binding proteins may also be utilized in the present invention, such as the promoters for LhcB gene and PsbP gene from white mustard (*Sinapis alba*; Kretsch et al., *Plant Mol. Biol.* 28:219-229 (1995), the entirety of which is herein incorporated by reference).

For the purpose of expression in sink tissues of the plant, such as the tuber of the potato plant, the fruit of tomato, or the seed of maize, wheat, rice and barley, it is preferred that the promoters utilized in the present invention have relatively high expression in these specific tissues. A number of promoters for genes with tuber-specific or -enhanced expression are known, including the class I patatin promoter (Bevan et al., *EMBO J.* 8:1899-1906 (1986); Jefferson et al., *Plant Mol. Biol.* 14:995-1006 (1990), both of which are herein incorporated by reference in its entirety), the promoter for the potato tuber ADPGPP genes, both the large and small subunits, the sucrose synthase promoter (Salanoubat and Belliard, *Gene.* 60:47-56 (1987), Salanoubat and Belliard, *Gene.* 84:181-185 (1989), both of which are incorporated by reference in their entirety), the promoter for the major tuber proteins including the 22 kd protein complexes and proteinase inhibitors (Hannapel, *Plant Physiol.* 101:703-704 (1993), herein incorporated by reference in its entirety), the promoter for the granule bound starch synthase gene (GBSS) (Visser et al., *Plant Mol. Biol.* 17:691-699 (1991), herein incorporated by reference in its entirety) and other class I and II patatins promoters (Koster-Topfer et al., *Mol Gen Genet.* 219:390-396 (1989); Mignery et al., *Gene.* 62:27-44 (1988), both of which are herein incorporated by reference in their entirety).

Other promoters can also be used to express a methionine pathway protein or fragment thereof in specific tissues, such as seeds or fruits. The promoter for β-conglycinin (Chen et al., *Dev. Genet.* 10: 112-122 (1989), herein incorporated by reference in its entirety) or other seed-specific promoters such as the napin and phaseolin promoters, can be used. The zeins are a group of storage proteins found in maize endosperm. Genomic clones for zein genes have been isolated (Pedersen et al., *Cell* 29:1015-1026 (1982), herein incorporated by reference in its entirety) and the promoters from these clones, including the 15 kD, 16 kD, 19 kD, 22 kD, 27 kD and γ genes, could also be used. Other promoters known to function, for example, in maize include the promoters for the following genes: waxy, *Brittle*, *Shrunken* 2, Branching enzymes I and II, starch synthases, debranching enzymes, oleosins, glutelins and sucrose synthases. A particularly preferred promoter for maize endosperm expression is the promoter for the glutelin gene from rice, more particularly the Osgt-1 promoter (Zheng et al., *Mol. Cell. Biol.* 13:5829-5842 (1993), herein incorporated by reference in its entirety). Examples of promoters suitable for expression in wheat include those promoters for the ADPglucose pyrosynthase (ADPGPP) subunits, the granule bound and other starch synthase, the branching and debranching enzymes, the embryogenesis-abundant proteins, the gliadins and the glutenins. Examples of such promoters in rice include those promoters for the ADPGPP subunits, the granule bound and other starch synthase, the branching enzymes, the debranching enzymes, sucrose synthases and the glutelins. A particularly preferred promoter is the promoter for rice glutelin, Osgt-1. Examples of such promoters for barley include those for the ADPGPP subunits, the granule bound and other starch synthase, the branching enzymes, the debranching enzymes, sucrose synthases, the hordeins, the embryo globulins and the aleurone specific proteins.

Root specific promoters may also be used. An example of such a promoter is the promoter for the acid chitinase gene (Samac et al., *Plant Mol. Biol.* 25:587-596 (1994), the entirety of which is herein incorporated by reference). Expression in root tissue could also be accomplished by utilizing the root specific subdomains of the CaMV35S promoter that have been identified (Lam et al., *Proc. Natl. Acad. Sci. (U.S.A.)* 86:7890-7894 (1989), herein incorporated by reference in its entirety). Other root cell specific promoters include those reported by Conkling et al. (Conkling et al., *Plant Physiol.* 93:1203-1211 (1990), the entirety of which is herein incorporated by reference).

Additional promoters that may be utilized are described, for example, in U.S. Pat. Nos. 5,378,619; 5,391,725; 5,428,147; 5,447,858; 5,608,144; 5,608,144; 5,614,399; 5,633,441; 5,633,435; and 4,633,436, all of which are herein incorporated in their entirety. In addition, a tissue specific enhancer may be used (Fromm et al., *The Plant Cell* 1:977-984 (1989), the entirety of which is herein incorporated by reference).

Constructs or vectors may also include with the coding region of interest a nucleic acid sequence that acts, in whole or in part, to terminate transcription of that region. For example, such sequences have been isolated including the Tr7 3' sequence and the NOS 3' sequence (Ingelbrecht et al., *The Plant Cell* 1:671-680 (1989), the entirety of which is herein incorporated by reference; Bevan et al., *Nucleic Acids Res.* 11:369-385 (1983), the entirety of which is herein incorporated by reference), or the like.

A vector or construct may also include regulatory elements. Examples of such include the Adh intron 1 (Callis et al., *Genes and Develop.* 1:1183-1200 (1987), the entirety of which is herein incorporated by reference), the sucrose synthase intron (Vasil et al., Plant Physiol. 91:1575-1579 (1989), the entirety of which is herein incorporated by reference) and the TMV omega element (Gallie et al., *The Plant Cell* 1:301-311 (1989), the entirety of which is herein incorporated by reference). These and other regulatory elements may be included when appropriate.

A vector or construct may also include a selectable marker. Selectable markers may also be used to select for plants or plant cells that contain the exogenous genetic material. Examples of such include, but are not limited to, a neo gene (Potrykus et al., *Mol. Gen. Genet.* 199:183-188 (1985), the entirety of which is herein incorporated by reference) which codes for kanamycin resistance and can be selected for using kanamycin, G418, etc.; a bar gene which codes for bialaphos resistance; a mutant EPSP synthase gene (Hinchee et al.,

*Bio/Technology* 6:915-922 (1988), the entirety of which is herein incorporated by reference) which encodes glyphosate resistance; a nitrilase gene which confers resistance to bromoxynil (Stalker et al., *J. Biol. Chem.* 263:6310-6314 (1988), the entirety of which is herein incorporated by reference); a mutant acetolactate synthase gene (ALS) which confers imidazolinone or sulphonylurea resistance (European Patent Application 154,204 (Sep. 11, 1985), the entirety of which is herein incorporated by reference); and a methotrexate resistant DHFR gene (Thillet et al., *J. Biol. Chem.* 263:12500-12508 (1988), the entirety of which is herein incorporated by reference).

A vector or construct may also include a transit peptide. Incorporation of a suitable chloroplast transit peptide may also be employed (European Patent Application Publication Number 0218571, the entirety of which is herein incorporated by reference). Translational enhancers may also be incorporated as part of the vector DNA. DNA constructs could contain one or more 5' non-translated leader sequences which may serve to enhance expression of the gene products from the resulting mRNA transcripts. Such sequences may be derived from the promoter selected to express the gene or can be specifically modified to increase translation of the mRNA. Such regions may also be obtained from viral RNAs, from suitable eukaryotic genes, or from a synthetic gene sequence. For a review of optimizing expression of transgenes, see Koziel et al., *Plant Mol. Biol.* 32:393-405 (1996), the entirety of which is herein incorporated by reference.

A vector or construct may also include a screenable marker. Screenable markers may be used to monitor expression. Exemplary screenable markers include a β-glucuronidase or uidA gene (GUS) which encodes an enzyme for which various chromogenic substrates are known (Jefferson, *Plant Mol. Biol, Rep.* 5:387-405 (1987), the entirety of which is herein incorporated by reference; Jefferson et al., *EMBO J.* 6:3901-3907 (1987), the entirety of which is herein incorporated by reference); an R-locus gene, which encodes a product that regulates the production of anthocyanin pigments (red color) in plant tissues (Dellaporta et al., Stadler Symposium 11:263-282 (1988), the entirety of which is herein incorporated by reference); a lactamase gene (Sutcliffe et al., *Proc. Natl. Acad. Sci. (U.S.A.)* 75:3737-3741 (1978), the entirety of which is herein incorporated by reference), a gene which encodes an enzyme for which various chromogenic substrates are known (e.g., PADAC, a chromogenic cephalosporin); a luciferase gene (Ow et al., *Science* 234:856-859 (1986), the entirety of which is herein incorporated by reference); a xylE gene (Zukowsky et al., *Proc. Natl. Acad. Sci. (U.S.A.)* 80:1101-1105 (1983), the entirety of which is herein incorporated by reference) which encodes a catechol diozygenase that can convert chromogenic catechols; an α-amylase gene (Ikatu et al., *Bio/Technol.* 8:241-242 (1990), the entirety of which is herein incorporated by reference); a tyrosinase gene (Katz et al., *J. Gen. Microbiol.* 129:2703-2714 (1983), the entirety of which is herein incorporated by reference) which encodes an enzyme capable of oxidizing tyrosine to DOPA and dopaquinone which in turn condenses to melanin; an α-galactosidase, which will turn a chromogenic α-galactose substrate.

Included within the terms "selectable or screenable marker genes" are also genes which encode a secretable marker whose secretion can be detected as a means of identifying or selecting for transformed cells. Examples include markers which encode a secretable antigen that can be identified by antibody interaction, or even secretable enzymes which can be detected catalytically. Secretable proteins fall into a number of classes, including small, diffusible proteins which are detectable, (e.g., by ELISA), small active enzymes which are detectable in extracellular solution (e.g., α-amylase, β-lactamase, phosphinothricin transferase), or proteins which are inserted or trapped in the cell wall (such as proteins which include a leader sequence such as that found in the expression unit of extension or tobacco PR-S). Other possible selectable and/or screenable marker genes will be apparent to those of skill in the art.

There are many methods for introducing transforming nucleic acid molecules into plant cells. Suitable methods are believed to include virtually any method by which nucleic acid molecules may be introduced into a cell, such as by *Agrobacterium* infection or direct delivery of nucleic acid molecules such as, for example, by PEG-mediated transformation, by electroporation or by acceleration of DNA coated particles, etc (Potrykus, *Ann. Rev. Plant Physiol. Plant Mol. Biol.* 42:205-225 (1991), the entirety of which is herein incorporated by reference; Vasil, *Plant Mol. Biol.* 25:925-937 (1994), the entirety of which is herein incorporated by reference). For example, electroporation has been used to transform maize protoplasts (Fromm et al., *Nature* 312:791-793 (1986), the entirety of which is herein incorporated by reference).

Other vector systems suitable for introducing transforming DNA into a host plant cell include but are not limited to binary artificial chromosome (BIBAC) vectors (Hamilton et al., *Gene* 200:107-116 (1997), the entirety of which is herein incorporated by reference); and transfection with RNA viral vectors (Della-Cioppa et al., *Ann. N.Y. Acad. Sci.* (1996), 792 (Engineering Plants for Commercial Products and Applications), 57-61, the entirety of which is herein incorporated by reference). Additional vector systems also include plant selectable YAC vectors such as those described in Mullen et al., *Molecular Breeding* 4:449-457 (1988), the entirety of which is herein incorporated by reference).

Technology for introduction of DNA into cells is well known to those of skill in the art. Four general methods for delivering a gene into cells have been described: (1) chemical methods (Graham and van der Eb, *Virology* 54:536-539 (1973), the entirety of which is herein incorporated by reference); (2) physical methods such as microinjection (Capecchi, *Cell* 22:479-488 (1980), the entirety of which is herein incorporated by reference), electroporation (Wong and Neumann, *Biochem. Biophys. Res. Commun.* 107:584-587 (1982); Fromm et al., *Proc. Natl. Acad. Sci. (U.S.A.)* 82:5824-5828 (1985); U.S. Pat. No. 5,384,253, all of which are herein incorporated in their entirety); and the gene gun (Johnston and Tang, *Methods Cell Biol.* 43:353-365 (1994), the entirety of which is herein incorporated by reference); (3) viral vectors (Clapp, *Clin. Perinatol.* 20:155-168 (1993); Lu et al., *J. Exp. Med.* 178:2089-2096 (1993); Eglitis and Anderson, *Biotechniques* 6:608-614 (1988), all of which are herein incorporated in their entirety); and (4) receptor-mediated mechanisms (Curiel et al., *Hum. Gen. Ther.* 3:147-154 (1992), Wagner et al., *Proc. Natl. Acad. Sci. (U.S.A.)* 89:6099-6103 (1992), both of which are incorporated by reference in their entirety).

Acceleration methods that may be used include, for example, microprojectile bombardment and the like. One example of a method for delivering transforming nucleic acid molecules to plant cells is microprojectile bombardment. This method has been reviewed by Yang and Christou (eds.), *Particle Bombardment Technology for Gene Transfer*, Oxford Press, Oxford, England (1994), the entirety of which is herein incorporated by reference). Non-biological particles (microprojectiles) that may be coated with nucleic acids and delivered into cells by a propelling force. Exemplary particles include those comprised of tungsten, gold, platinum and the like.

A particular advantage of microprojectile bombardment, in addition to it being an effective means of reproducibly transforming monocots, is that neither the isolation of protoplasts (Cristou et al., *Plant Physiol.* 87:671-674 (1988), the entirety of which is herein incorporated by reference) nor the susceptibility of *Agrobacterium* infection are required. An illustrative embodiment of a method for delivering DNA into maize cells by acceleration is a biolistics α-particle delivery system, which can be used to propel particles coated with DNA through a screen, such as a stainless steel or Nytex screen, onto a filter surface covered with corn cells cultured in suspension. Gordon-Kamm et al., describes the basic procedure for coating tungsten particles with DNA (Gordon-Kamm et al., *Plant Cell* 2:603-618 (1990), the entirety of which is herein incorporated by reference). The screen disperses the tungsten nucleic acid particles so that they are not delivered to the recipient cells in large aggregates. A particle delivery system suitable for use with the present invention is the helium acceleration PDS-1000/He gun is available from Bio-Rad Laboratories (Bio-Rad, Hercules, Calif.) (Sanford et al., *Technique* 3:3-16 (1991), the entirety of which is herein incorporated by reference).

For the bombardment, cells in suspension may be concentrated on filters. Filters containing the cells to be bombarded are positioned at an appropriate distance below the microprojectile stopping plate. If desired, one or more screens are also positioned between the gun and the cells to be bombarded.

Alternatively, immature embryos or other target cells may be arranged on solid culture medium. The cells to be bombarded are positioned at an appropriate distance below the microprojectile stopping plate. If desired, one or more screens are also positioned between the acceleration device and the cells to be bombarded. Through the use of techniques set forth herein one may obtain up to 1000 or more foci of cells transiently expressing a marker gene. The number of cells in a focus which express the exogenous gene product 48 hours post-bombardment often range from one to ten and average one to three.

In bombardment transformation, one may optimize the pre-bombardment culturing conditions and the bombardment parameters to yield the maximum numbers of stable transformants. Both the physical and biological parameters for bombardment are important in this technology. Physical factors are those that involve manipulating the DNA/microprojectile precipitate or those that affect the flight and velocity of either the macro- or microprojectiles. Biological factors include all steps involved in manipulation of cells before and immediately after bombardment, the osmotic adjustment of target cells to help alleviate the trauma associated with bombardment and also the nature of the transforming DNA, such as linearized DNA or intact supercoiled plasmids. It is believed that pre-bombardment manipulations are especially important for successful transformation of immature embryos.

In another alternative embodiment, plastids can be stably transformed. Methods disclosed for plastid transformation in higher plants include the particle gun delivery of DNA containing a selectable marker and targeting of the DNA to the plastid genome through homologous recombination (Svab et al., *Proc. Natl. Acad. Sci.* (*U.S.A.*) 87:8526-8530 (1990); Svab and Maliga, *Proc. Natl. Acad. Sci.* (*U.S.A.*) 90:913-917 (1993); Staub and Maliga, *EMBO J.* 12:601-606 (1993); U.S. Pat. Nos. 5,451,513 and 5,545,818, all of which are herein incorporated by reference in their entirety).

Accordingly, it is contemplated that one may wish to adjust various aspects of the bombardment parameters in small scale studies to fully optimize the conditions. One may particularly wish to adjust physical parameters such as gap distance, flight distance, tissue distance and helium pressure. One may also minimize the trauma reduction factors by modifying conditions which influence the physiological state of the recipient cells and which may therefore influence transformation and integration efficiencies. For example, the osmotic state, tissue hydration and the subculture stage or cell cycle of the recipient cells may be adjusted for optimum transformation. The execution of other routine adjustments will be known to those of skill in the art in light of the present disclosure.

*Agrobacterium*-mediated transfer is a widely applicable system for introducing genes into plant cells because the DNA can be introduced into whole plant tissues, thereby bypassing the need for regeneration of an intact plant from a protoplast. The use of *Agrobacterium*-mediated plant integrating vectors to introduce DNA into plant cells is well known in the art. See, for example the methods described by Fraley et al., *Bio/Technology* 3:629-635 (1985) and Rogers et al., *Methods Enzymol.* 153:253-277 (1987), both of which are herein incorporated by reference in their entirety. Further, the integration of the Ti-DNA is a relatively precise process resulting in few rearrangements. The region of DNA to be transferred is defined by the border sequences and intervening DNA is usually inserted into the plant genome as described (Spielmann et al., *Mol. Gen. Genet.* 205:34 (1986), the entirety of which is herein incorporated by reference).

Modern *Agrobacterium* transformation vectors are capable of replication in *E. coli* as well as *Agrobacterium*, allowing for convenient manipulations as described (Klee et al., In: *Plant DNA Infectious Agents*, Hohn and Schell (eds.), Springer-Verlag, New York, pp. 179-203 (1985), the entirety of which is herein incorporated by reference. Moreover, technological advances in vectors for *Agrobacterium*-mediated gene transfer have improved the arrangement of genes and restriction sites in the vectors to facilitate construction of vectors capable of expressing various polypeptide coding genes. The vectors described have convenient multi-linker regions flanked by a promoter and a polyadenylation site for direct expression of inserted polypeptide coding genes and are suitable for present purposes (Rogers et al., *Methods Enzymol.* 153:253-277 (1987)). In addition, *Agrobacterium* containing both armed and disarmed Ti genes can be used for the transformations. In those plant strains where *Agrobacterium*-mediated transformation is efficient, it is the method of choice because of the facile and defined nature of the gene transfer.

A transgenic plant formed using *Agrobacterium* transformation methods typically contains a single gene on one chromosome. Such transgenic plants can be referred to as being heterozygous for the added gene. More preferred is a transgenic plant that is homozygous for the added structural gene; i.e., a transgenic plant that contains two added genes, one gene at the same locus on each chromosome of a chromosome pair. A homozygous transgenic plant can be obtained by sexually mating (selfing) an independent segregant transgenic plant that contains a single added gene, germinating some of the seed produced and analyzing the resulting plants produced for the gene of interest.

It is also to be understood that two different transgenic plants can also be mated to produce offspring that contain two independently segregating added, exogenous genes. Selfing of appropriate progeny can produce plants that are homozygous for both added, exogenous genes that encode a polypeptide of interest. Back-crossing to a parental plant and outcrossing with a non-transgenic plant are also contemplated, as is vegetative propagation.

Transformation of plant protoplasts can be achieved using methods based on calcium phosphate precipitation, polyethylene glycol treatment, electroporation and combinations of these treatments (See, for example, Potrykus et al., *Mol. Gen. Genet.* 205:193-200 (1986); Lorz et al., *Mol. Gen. Genet.* 199:178 (1985); Fromm et al., *Nature* 319:791 (1986); Uchimiya et al., *Mol. Gen. Genet.* 204:204 (1986); Marcotte et al., *Nature* 335:454-457 (1988), all of which are herein incorporated by reference in their entirety).

Application of these systems to different plant strains depends upon the ability to regenerate that particular plant strain from protoplasts. Illustrative methods for the regeneration of cereals from protoplasts are described (Fujimura et al., *Plant Tissue Culture Letters* 2:74 (1985); Toriyama et al., *Theor Appl. Genet.* 205:34 (1986); Yamada et al., *Plant Cell Rep.* 4:85 (1986); Abdullah et al., *Biotechnolog* 4:1087 (1986), all of which are herein incorporated by reference in their entirety).

To transform plant strains that cannot be successfully regenerated from protoplasts, other ways to introduce DNA into intact cells or tissues can be utilized. For example, regeneration of cereals from immature embryos or explants can be effected as described (Vasil, *Biotechnology* 6:397 (1988), the entirety of which is herein incorporated by reference). In addition, "particle gun" or high-velocity microprojectile technology can be utilized (Vasil et al., *Bio/Technology* 10:667 (1992), the entirety of which is herein incorporated by reference).

Using the latter technology, DNA is carried through the cell wall and into the cytoplasm on the surface of small metal particles as described (Klein et al., *Nature* 328:70 (1987); Klein et al., *Proc. Natl. Acad. Sci.* (*U.S.A.*) 85:8502-8505 (1988); McCabe et al., *Bio/Technology* 6:923 (1988), all of which are herein incorporated by reference in their entirety). The metal particles penetrate through several layers of cells and thus allow the transformation of cells within tissue explants.

Other methods of cell transformation can also be used and include but are not limited to introduction of DNA into plants by direct DNA transfer into pollen (Zhou et al., *Methods Enzymol.* 101:433 (1983); Hess et al., *Intern Rev. Cytol.* 107: 367 (1987); Luo et al., *Plant Mol. Biol. Reporter* 6:165 (1988), all of which are herein incorporated by reference in their entirety), by direct injection of DNA into reproductive organs of a plant (Pena et al., *Nature* 325:274 (1987), the entirety of which is herein incorporated by reference), or by direct injection of DNA into the cells of immature embryos followed by the rehydration of desiccated embryos (Neuhaus et al., *Theor. Appl. Genet.* 75:30 (1987), the entirety of which is herein incorporated by reference).

The regeneration, development and cultivation of plants from single plant protoplast transformants or from various transformed explants is well known in the art (Weissbach and Weissbach, In: *Methods for Plant Molecular Biology*, Academic Press, San Diego, Calif., (1988), the entirety of which is herein incorporated by reference). This regeneration and growth process typically includes the steps of selection of transformed cells, culturing those individualized cells through the usual stages of embryonic development through the rooted plantlet stage. Transgenic embryos and seeds are similarly regenerated. The resulting transgenic rooted shoots are thereafter planted in an appropriate plant growth medium such as soil.

The development or regeneration of plants containing the foreign, exogenous gene that encodes a protein of interest is well known in the art. Preferably, the regenerated plants are self-pollinated to provide homozygous transgenic plants. Otherwise, pollen obtained from the regenerated plants is crossed to seed-grown plants of agronomically important lines. Conversely, pollen from plants of these important lines is used to pollinate regenerated plants. A transgenic plant of the present invention containing a desired polypeptide is cultivated using methods well known to one skilled in the art.

There are a variety of methods for the regeneration of plants from plant tissue. The particular method of regeneration will depend on the starting plant tissue and the particular plant species to be regenerated.

Methods for transforming dicots, primarily by use of *Agrobacterium tumefaciens* and obtaining transgenic plants have been published for cotton (U.S. Pat. No. 5,004,863; U.S. Pat. No. 5,159,135; U.S. Pat. No. 5,518,908, all of which are herein incorporated by reference in their entirety); soybean (U.S. Pat. No. 5,569,834; U.S. Pat. No. 5,416,011; McCabe et. al., *Biotechnology* 6:923 (1988); Christou et al., *Plant Physiol.* 87:671-674 (1988); all of which are herein incorporated by reference in their entirety); Brassica (U.S. Pat. No. 5,463,174, the entirety of which is herein incorporated by reference); peanut (Cheng et al., *Plant Cell Rep.* 15:653-657 (1996), McKently et al., *Plant Cell Rep.* 14:699-703 (1995), all of which are herein incorporated by reference in their entirety); papaya; and pea (Grant et al., *Plant Cell Rep.* 15:254-258 (1995), the entirety of which is herein incorporated by reference).

Transformation of monocotyledons using electroporation, particle bombardment and *Agrobacterium* have also been reported. Transformation and plant regeneration have been achieved in asparagus (Bytebier et al., *Proc. Natl. Acad. Sci.* (*U.S.A.*) 84:5354 (1987), the entirety of which is herein incorporated by reference); barley (Wan and Lemaux, *Plant Physiol* 104:37 (1994), the entirety of which is herein incorporated by reference); maize (Rhodes et al., *Science* 240:204 (1988); Gordon-Kamm et al., *Plant Cell* 2:603-618 (1990); Fromm et al., *Bio/Technology* 8:833 (1990); Koziel et al., *Bio/Technology* 11:194 (1993); Armstrong et al., *Crop Science* 35:550-557 (1995); all of which are herein incorporated by reference in their entirety); oat (Somers et al., *Bio/Technology* 10:1589 (1992), the entirety of which is herein incorporated by reference); orchard grass (Horn et al., *Plant Cell Rep.* 7:469 (1988), the entirety of which is herein incorporated by reference); rice (Toriyama et al., *Theor Appl. Genet.* 205:34 (1986); Part et al., *Plant Mol. Biol.* 32:1135-1148 (1996); Abedinia et al., *Aust. J. Plant Physiol.* 24:133-141 (1997); Zhang and Wu, *Theor. Appl. Genet.* 76:835 (1988); Zhang et al., *Plant Cell Rep.* 7:379 (1988); Battraw and Hall, *Plant Sci.* 86:191-202 (1992); Christou et al., *Bio/Technology* 9:957 (1991), all of which are herein incorporated by reference in their entirety); rye (De la Pena et al., *Nature* 325:274 (1987), the entirety of which is herein incorporated by reference); sugarcane (Bower and Birch, *Plant J.* 2:409 (1992), the entirety of which is herein incorporated by reference); tall fescue (Wang et al., *Bio/Technology* 10:691 (1992), the entirety of which is herein incorporated by reference) and wheat (Vasil et al., *Bio/Technology* 10:667 (1992), the entirety of which is herein incorporated by reference; U.S. Pat. No. 5,631,152, the entirety of which is herein incorporated by reference.)

Assays for gene expression based on the transient expression of cloned nucleic acid constructs have been developed by introducing the nucleic acid molecules into plant cells by polyethylene glycol treatment, electroporation, or particle bombardment (Marcotte et al., *Nature* 335:454-457 (1988), the entirety of which is herein incorporated by reference; Marcotte et al., *Plant Cell* 1:523-532 (1989), the entirety of which is herein incorporated by reference; McCarty et al., *Cell* 66:895-905 (1991), the entirety of which is herein incorporated by reference; Hattori et al., *Genes Dev.* 6:609-618 (1992), the entirety of which is herein incorporated by reference; Goff et al., *EMBO J.* 9:2517-2522 (1990), the entirety of which is herein incorporated by reference). Transient expression systems may be used to functionally dissect gene constructs (see generally, Mailga et al., *Methods in Plant Molecular Biology*, Cold Spring Harbor Press (1995)).

Any of the nucleic acid molecules of the present invention may be introduced into a plant cell in a permanent or transient manner in combination with other genetic elements such as vectors, promoters, enhancers etc. Further, any of the nucleic acid molecules of the present invention may be introduced into a plant cell in a manner that allows for overexpression of the protein or fragment thereof encoded by the nucleic acid molecule.

Cosuppression is the reduction in expression levels, usually at the level of RNA, of a particular endogenous gene or gene family by the expression of a homologous sense construct that is capable of transcribing mRNA of the same strandedness as the transcript of the endogenous gene (Napoli et al., *Plant Cell* 2:279-289 (1990), the entirety of which is herein incorporated by reference; van der Krol et al., *Plant Cell* 2:291-299 (1990), the entirety of which is herein incorporated by reference). Cosuppression may result from stable transformation with a single copy nucleic acid molecule that is homologous to a nucleic acid sequence found with the cell (Prolls and Meyer, *Plant J.* 2:465-475 (1992), the entirety of which is herein incorporated by reference) or with multiple copies of a nucleic acid molecule that is homologous to a nucleic acid sequence found with the cell (Mittlesten et al., *Mol. Gen. Genet.* 244:325-330 (1994), the entirety of which is herein incorporated by reference). Genes, even though different, linked to homologous promoters may result in the cosuppression of the linked genes (Vaucheret, C. R. *Acad. Sci. III* 316:1471-1483 (1993), the entirety of which is herein incorporated by reference).

This technique has, for example, been applied to generate white flowers from red petunia and tomatoes that do not ripen on the vine. Up to 50% of petunia transformants that contained a sense copy of the glucoamylase (CHS) gene produced white flowers or floral sectors; this was as a result of the post-transcriptional loss of mRNA encoding CHS (Flavell, *Proc. Natl. Acad. Sci.* (*U.S.A.*) 91:3490-3496 (1994), the entirety of which is herein incorporated by reference); van Blokland et al., *Plant J.* 6:861-877 (1994), the entirety of which is herein incorporated by reference). Cosuppression may require the coordinate transcription of the transgene and the endogenous gene and can be reset by a developmental control mechanism (Jorgensen, *Trends Biotechnol.* 8:340-344 (1990), the entirety of which is herein incorporated by reference; Meins and Kunz, In: *Gene Inactivation and Homologous Recombination in Plants*, Paszkowski (ed.), pp. 335-348, Kluwer Academic, Netherlands (1994), the entirety of which is herein incorporated by reference).

It is understood that one or more of the nucleic acids of the present invention may be introduced into a plant cell and transcribed using an appropriate promoter with such transcription resulting in the cosuppression of an endogenous methionine pathway protein.

Antisense approaches are a way of preventing or reducing gene function by targeting the genetic material (Mol et al., *FEBS Lett.* 268:427-430 (1990), the entirety of which is herein incorporated by reference). The objective of the antisense approach is to use a sequence complementary to the target gene to block its expression and create a mutant cell line or organism in which the level of a single chosen protein is selectively reduced or abolished. Antisense techniques have several advantages over other 'reverse genetic' approaches. The site of inactivation and its developmental effect can be manipulated by the choice of promoter for antisense genes or by the timing of external application or microinjection. Antisense can manipulate its specificity by selecting either unique regions of the target gene or regions where it shares homology to other related genes (Hiatt et al., In: *Genetic Engineering*, Setlow (ed.), Vol. 11, New York: Plenum 49-63 (1989), the entirety of which is herein incorporated by reference).

The principle of regulation by antisense RNA is that RNA that is complementary to the target mRNA is introduced into cells, resulting in specific RNA:RNA duplexes being formed by base pairing between the antisense substrate and the target mRNA (Green et al., *Annu. Rev. Biochem.* 55:569-597 (1986), the entirety of which is herein incorporated by reference). Under one embodiment, the process involves the introduction and expression of an antisense gene sequence. Such a sequence is one in which part or all of the normal gene sequences are placed under a promoter in inverted orientation so that the 'wrong' or complementary strand is transcribed into a noncoding antisense RNA that hybridizes with the target mRNA and interferes with its expression (Takayama and Inouye, *Crit. Rev. Biochem. Mol. Biol.* 25:155-184 (1990), the entirety of which is herein incorporated by reference). An antisense vector is constructed by standard procedures and introduced into cells by transformation, transfection, electroporation, microinjection, infection, etc. The type of transformation and choice of vector will determine whether expression is transient or stable. The promoter used for the antisense gene may influence the level, timing, tissue, specificity, or inducibility of the antisense inhibition.

It is understood that the activity of a methionine pathway protein in a plant cell may be reduced or depressed by growing a transformed plant cell containing a nucleic acid molecule whose non-transcribed strand encodes a methionine pathway protein or fragment thereof.

Antibodies have been expressed in plants (Hiatt et al., *Nature* 342:76-78 (1989), the entirety of which is herein incorporated by reference; Conrad and Fielder, *Plant Mol. Biol.* 26:1023-1030 (1994), the entirety of which is herein incorporated by reference). Cytoplamsic expression of a scFv (single-chain Fv antibodies) has been reported to delay infection by artichoke mottled crinkle virus. Transgenic plants that express antibodies directed against endogenous proteins may exhibit a physiological effect (Philips et al., *EMBO J.* 16:4489-4496 (1997), the entirety of which is herein incorporated by reference; Marion-Poll, *Trends in Plant Science* 2:447-448 (1997), the entirety of which is herein incorporated by reference). For example, expressed anti-abscisic antibodies have been reported to result in a general perturbation of seed development (Philips et al., *EMBO J.* 16: 4489-4496 (1997)).

Antibodies that are catalytic may also be expressed in plants (abzymes). The principle behind abzymes is that since antibodies may be raised against many molecules, this recognition ability can be directed toward generating antibodies that bind transition states to force a chemical reaction forward (Persidas, *Nature Biotechnology* 15:1313-1315 (1997), the entirety of which is herein incorporated by reference; Baca et al., *Ann. Rev. Biophys. Biomol. Struct.* 26:461-493 (1997), the entirety of which is herein incorporated by reference). The catalytic abilities of abzymes may be enhanced by site directed mutagenesis. Examples of abzymes are, for example, set forth in U.S. Pat. No. 5,658,753; U.S. Pat. No. 5,632,990; U.S. Pat. No. 5,631,137; U.S. Pat. No. 5,602,015; U.S. Pat. No. 5,559,538; U.S. Pat. No. 5,576,174; U.S. Pat. No. 5,500,358; U.S. Pat. No. 5,318,897; U.S. Pat. No. 5,298,409; U.S. Pat. No. 5,258,289 and U.S. Pat. No. 5,194,585, all of which are herein incorporated in their entirety.

It is understood that any of the antibodies of the present invention may be expressed in plants and that such expression can result in a physiological effect. It is also understood that any of the expressed antibodies may be catalytic.

(b) Fungal Constructs and Fungal Transformants

The present invention also relates to a fungal recombinant vector comprising exogenous genetic material. The present invention also relates to a fungal cell comprising a fungal recombinant vector. The present invention also relates to methods for obtaining a recombinant fungal host cell comprising introducing into a fungal host cell exogenous genetic material.

Exogenous genetic material may be transferred into a fungal cell. In a preferred embodiment the exogenous genetic material includes a nucleic acid molecule of the present invention having a sequence selected from the group consisting of SEQ ID NO: 1 through SEQ ID NO: 3204 or complements thereof or fragments of either. The fungal recombinant vector may be any vector which can be conveniently subjected to recombinant DNA procedures. The choice of a vector will typically depend on the compatibility of the vector with the fungal host cell into which the vector is to be introduced. The vector may be a linear or a closed circular plasmid. The vector system may be a single vector or plasmid or two or more vectors or plasmids which together contain the total DNA to be introduced into the genome of the fungal host.

The fungal vector may be an autonomously replicating vector, i.e., a vector which exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the fungal cell, is integrated into the genome and replicated together with the chromosome(s) into which it has been integrated. For integration, the vector may rely on the nucleic acid sequence of the vector for stable integration of the vector into the genome by homologous or nonhomologous recombination. Alternatively, the vector may contain additional nucleic acid sequences for directing integration by homologous recombination into the genome of the fungal host. The additional nucleic acid sequences enable the vector to be integrated into the host cell genome at a precise location(s) in the chromosome(s). To increase the likelihood of integration at a precise location, there should be preferably two nucleic acid sequences which individually contain a sufficient number of nucleic acids, preferably 400 bp to 1500 bp, more preferably 800 bp to 1000 bp, which are highly homologous with the corresponding target sequence to enhance the probability of homologous recombination. These nucleic acid sequences may be any sequence that is homologous with a target sequence in the genome of the fungal host cell and, furthermore, may be non-encoding or encoding sequences.

For autonomous replication, the vector may further comprise an origin of replication enabling the vector to replicate autonomously in the host cell in question. Examples of origin of replications for use in a yeast host cell are the 2 micron origin of replication and the combination of CEN3 and ARS 1. Any origin of replication may be used which is compatible with the fungal host cell of choice.

The fungal vectors of the present invention preferably contain one or more selectable markers which permit easy selection of transformed cells. A selectable marker is a gene the product of which provides, for example biocide or viral resistance, resistance to heavy metals, prototrophy to auxotrophs and the like. The selectable marker may be selected from the group including, but not limited to, amdS (acetamidase), argB (ornithine carbamoyltransferase), bar (phosphinothricin acetyltransferase), hygB (hygromycin phosphotransferase), niaD (nitrate reductase), pyrG (orotidine-5'-phosphate decarboxylase) and sC (sulfate adenyltransferase) and trpC (anthranilate synthase). Preferred for use in an *Aspergillus* cell are the amdS and pyrG markers of *Aspergillus nidulans* or *Aspergillus oryzae* and the bar marker of *Streptomyces hygroscopicus*. Furthermore, selection may be accomplished by co-transformation, e.g., as described in WO 91/17243, the entirety of which is herein incorporated by reference. A nucleic acid sequence of the present invention may be operably linked to a suitable promoter sequence. The promoter sequence is a nucleic acid sequence which is recognized by the fungal host cell for expression of the nucleic acid sequence. The promoter sequence contains transcription and translation control sequences which mediate the expression of the protein or fragment thereof.

A promoter may be any nucleic acid sequence which shows transcriptional activity in the fungal host cell of choice and may be obtained from genes encoding polypeptides either homologous or heterologous to the host cell. Examples of suitable promoters for directing the transcription of a nucleic acid construct of the invention in a filamentous fungal host are promoters obtained from the genes encoding *Aspergillus oryzae* TAKA amylase, *Rhizomucor miehei* aspartic proteinase, *Aspergillus niger* neutral alpha-amylase, *Aspergillus niger* acid stable alpha-amylase, *Aspergillus niger* or *Aspergillus awamori* glucoamylase (glaA), *Rhizomucor miehei* lipase, *Aspergillus oryzae* alkaline protease, *Aspergillus oryzae* triose phosphate isomerase, *Aspergillus nidulans* acetamidase and hybrids thereof. In a yeast host, a useful promoter is the *Saccharomyces cerevisiae* enolase (eno-1) promoter. Particularly preferred promoters are the TAKA amylase, NA2-tpi (a hybrid of the promoters from the genes encoding *Aspergillus niger* neutral alpha-amylase and *Aspergillus oryzae* triose phosphate isomerase) and glaA promoters.

A protein or fragment thereof encoding nucleic acid molecule of the present invention may also be operably linked to a terminator sequence at its 3' terminus. The terminator sequence may be native to the nucleic acid sequence encoding the protein or fragment thereof or may be obtained from foreign sources. Any terminator which is functional in the fungal host cell of choice may be used in the present invention, but particularly preferred terminators are obtained from the genes encoding *Aspergillus oryzae* TAKA amylase, *Aspergillus niger* glucoamylase, *Aspergillus nidulans* anthranilate synthase, *Aspergillus niger* alpha-glucosidase and *Saccharomyces cerevisiae* enolase.

A protein or fragment thereof encoding nucleic acid molecule of the present invention may also be operably linked to a suitable leader sequence. A leader sequence is a nontranslated region of a mRNA which is important for translation by the fungal host. The leader sequence is operably linked to the 5' terminus of the nucleic acid sequence encoding the protein or fragment thereof. The leader sequence may be native to the nucleic acid sequence encoding the protein or fragment thereof or may be obtained from foreign sources. Any leader sequence which is functional in the fungal host cell of choice may be used in the present invention, but particularly preferred leaders are obtained from the genes encoding *Aspergillus oryzae* TAKA amylase and *Aspergillus oryzae* triose phosphate isomerase.

A polyadenylation sequence may also be operably linked to the 3' terminus of the nucleic acid sequence of the present invention. The polyadenylation sequence is a sequence which when transcribed is recognized by the fungal host to add polyadenosine residues to transcribed mRNA. The polyadenylation sequence may be native to the nucleic acid sequence encoding the protein or fragment thereof or may be obtained from foreign sources. Any polyadenylation sequence which is functional in the fungal host of choice may be used in the present invention, but particularly preferred polyadenylation sequences are obtained from the genes encoding *Aspergillus oryzae* TAKA amylase, *Aspergillus niger* glucoamylase, *Aspergillus nidulans* anthranilate synthase and *Aspergillus niger* alpha-glucosidase.

To avoid the necessity of disrupting the cell to obtain the protein or fragment thereof and to minimize the amount of possible degradation of the expressed protein or fragment thereof within the cell, it is preferred that expression of the protein or fragment thereof gives rise to a product secreted outside the cell. To this end, a protein or fragment thereof of the present invention may be linked to a signal peptide linked to the amino terminus of the protein or fragment thereof. A signal peptide is an amino acid sequence which permits the secretion of the protein or fragment thereof from the fungal host into the culture medium. The signal peptide may be native to the protein or fragment thereof of the invention or may be obtained from foreign sources. The 5' end of the coding sequence of the nucleic acid sequence of the present invention may inherently contain a signal peptide coding region naturally linked in translation reading frame with the segment of the coding region which encodes the secreted protein or fragment thereof. Alternatively, the 5' end of the coding sequence may contain a signal peptide coding region which is foreign to that portion of the coding sequence which encodes the secreted protein or fragment thereof. The foreign signal peptide may be required where the coding sequence does not normally contain a signal peptide coding region. Alternatively, the foreign signal peptide may simply replace the natural signal peptide to obtain enhanced secretion of the desired protein or fragment thereof. The foreign signal peptide coding region may be obtained from a glucoamylase or an amylase gene from an *Aspergillus* species, a lipase or proteinase gene from *Rhizomucor miehei*, the gene for the alpha-factor from *Saccharomyces cerevisiae*, or the calf preprochymosin gene. An effective signal peptide for fungal host cells is the *Aspergillus oryzae* TAKA amylase signal, *Aspergillus niger* neutral amylase signal, the *Rhizomucor miehei* aspartic proteinase signal, the *Humicola lanuginosus* cellulase signal, or the *Rhizomucor miehei* lipase signal. However, any signal peptide capable of permitting secretion of the protein or fragment thereof in a fungal host of choice may be used in the present invention.

A protein or fragment thereof encoding nucleic acid molecule of the present invention may also be linked to a propeptide coding region. A propeptide is an amino acid sequence found at the amino terminus of a proprotein or proenzyme. Cleavage of the propeptide from the proprotein yields a mature biochemically active protein. The resulting polypeptide is known as a propolypeptide or proenzyme (or a zymogen in some cases). Propolypeptides are generally inactive and can be converted to mature active polypeptides by catalytic or autocatalytic cleavage of the propeptide from the propolypeptide or proenzyme. The propeptide coding region may be native to the protein or fragment thereof or may be obtained from foreign sources. The foreign propeptide coding region may be obtained from the *Saccharomyces cerevisiae* alpha-factor gene or *Myceliophthora thermophila* laccase gene (WO 95/33836, the entirety of which is herein incorporated by reference).

The procedures used to ligate the elements described above to construct the recombinant expression vector of the present invention are well known to one skilled in the art (see, for example, Sambrook et al., *Molecular Cloning, A Laboratory Manual,* 2nd ed., Cold Spring Harbor, N.Y., (1989)).

The present invention also relates to recombinant fungal host cells produced by the methods of the present invention which are advantageously used with the recombinant vector of the present invention. The cell is preferably transformed with a vector comprising a nucleic acid sequence of the invention followed by integration of the vector into the host chromosome. The choice of fungal host cells will to a large extent depend upon the gene encoding the protein or fragment thereof and its source. The fungal host cell may, for example, be a yeast cell or a filamentous fungal cell.

"Yeast" as used herein includes Ascosporogenous yeast (*Endomycetales*), Basidiosporogenous yeast and yeast belonging to the Fungi Imperfecti (*Blastomycetes*). The Ascosporogenous yeasts are divided into the families Spermophthoraceae and Saccharomycetaceae. The latter is comprised of four subfamilies, Schizosaccharomycoideae (for example, genus *Schizosaccharomyces*), Nadsonioideae, Lipomycoideae and Saccharomycoideae (for example, genera *Pichia, Kluyveromyces* and *Saccharomyces*). The Basidiosporogenous yeasts include the genera *Leucosporidim, Rhodosporidium, Sporidiobolus, Filobasidium* and *Filobasidiella*. Yeast belonging to the Fungi Imperfecti are divided into two families, Sporobolomycetaceae (for example, genera *Sorobolomyces* and *Bullera*) and Cryptococcaceae (for example, genus *Candida*). Since the classification of yeast may change in the future, for the purposes of this invention, yeast shall be defined as described in Biology and Activities of Yeast (Skinner et al., *Soc. App. Bacteriol. Symposium Series* No. 9, (1980), the entirety of which is herein incorporated by reference). The biology of yeast and manipulation of yeast genetics are well known in the art (see, for example, *Biochemistry and Genetics of Yeast,* Bacil et al. (ed.), 2nd edition, 1987; *The Yeasts,* Rose and Harrison (eds.), 2nd ed., (1987); and *The Molecular Biology of the Yeast Saccharomyces,* Strathern et al. (eds.), (1981), all of which are herein incorporated by reference in their entirety).

"Fungi" as used herein includes the phyla Ascomycota, Basidiomycota, Chytridiomycota and Zygomycota (as defined by Hawksworth et al., In: Ainsworth and Bisby's *Dictionary of The Fungi,* 8th edition, 1995, CAB International, University Press, Cambridge, UK; the entirety of which is herein incorporated by reference) as well as the Oomycota (as cited in Hawksworth et al., In: Ainsworth and Bisby's *Dictionary of The Fungi,* 8th edition, 1995, CAB International, University Press, Cambridge, UK) and all mitosporic fungi (Hawksworth et al., In: Ainsworth and Bisby's *Dictionary of The Fungi,* 8th edition, 1995, CAB International, University Press, Cambridge, UK). Representative groups of Ascomycota include, for example, *Neurospora, Eupenicillium* (=*Penicillium*), *Emericella* (=*Aspergillus*), *Eurotiun* (=*Aspergillus*) and the true yeasts listed above. Examples of Basidiomycota include mushrooms, rusts and smuts. Representative groups of Chytridiomycota include, for example, *Allomyces, Blastocladiella, Coelomomyces* and aquatic fungi. Representative groups of Oomycota include, for example, *Saprolegniomycetous* aquatic fungi (water molds) such as *Achlya*. Examples of mitosporic fungi include

*Aspergillus, Penicilliun, Candida* and *Alternaria*. Representative groups of Zygomycota include, for example, *Rhizopus* and *Mucor*.

"Filamentous fungi" include all filamentous forms of the subdivision Eumycota and Oomycota (as defined by Hawksworth et al., In: Ainsworth and Bisby's *Dictionary of The Fungi*, 8th edition, 1995, CAB International, University Press, Cambridge, UK). The filamentous fungi are characterized by a vegetative mycelium composed of chitin, cellulose, glucan, chitosan, mannan and other complex polysaccharides. Vegetative growth is by hyphal elongation and carbon catabolism is obligately aerobic. In contrast, vegetative growth by yeasts such as *Saccharomyces cerevisiae* is by budding of a unicellular thallus and carbon catabolism may be fermentative.

In one embodiment, the fungal host cell is a yeast cell. In a preferred embodiment, the yeast host cell is a cell of the species of *Candida, Kluyveromyces, Saccharomyces, Schizosaccharomyces, Pichia* and *Yarrowia*. In a preferred embodiment, the yeast host cell is a *Saccharomyces cerevisiae* cell, a *Saccharomyces carlsbergensis, Saccharomyces diastaticus* cell, a *Saccharomyces douglasii* cell, a *Saccharomyces kluyveri* cell, a *Saccharomyces norbensis* cell, or a *Saccharomyces oviformis* cell. In another preferred embodiment, the yeast host cell is a *Kluyveromyces lactis* cell. In another preferred embodiment, the yeast host cell is a *Yarrowia lipolytica* cell.

In another embodiment, the fungal host cell is a filamentous fungal cell. In a preferred embodiment, the filamentous fungal host cell is a cell of the species of, but not limited to, *Acremonium, Aspergillus, Fusarium, Humicola, Myceliophthora, Mucor, Neurospora, Penicillium, Thielavia, Tolypocladium* and *Trichoderma*. In a preferred embodiment, the filamentous fungal host cell is an *Aspergillus* cell. In another preferred embodiment, the filamentous fungal host cell is an *Acremonium* cell. In another preferred embodiment, the filamentous fungal host cell is a *Fusarium* cell. In another preferred embodiment, the filamentous fungal host cell is a *Humicola* cell. In another preferred embodiment, the filamentous fungal host cell is a *Myceliophthora* cell. In another even preferred embodiment, the filamentous fungal host cell is a *Mucor* cell. In another preferred embodiment, the filamentous fungal host cell is a *Neurospora* cell. In another preferred embodiment, the filamentous fungal host cell is a *Penicillium* cell. In another preferred embodiment, the filamentous fungal host cell is a *Thielavia* cell. In another preferred embodiment, the filamentous fungal host cell is a *Tolypocladiun* cell. In another preferred embodiment, the filamentous fungal host cell is a *Trichoderma* cell. In a preferred embodiment, the filamentous fungal host cell is an *Aspergillus oryzae* cell, an *Aspergillus niger* cell, an *Aspergillus foetidus* cell, or an *Aspergillus japonicus* cell. In another preferred embodiment, the filamentous fungal host cell is a *Fusarium oxysporum* cell or a *Fusarium graminearum* cell. In another preferred embodiment, the filamentous fungal host cell is a *Humicola insolens* cell or a *Humicola lanuginosus* cell. In another preferred embodiment, the filamentous fungal host cell is a *Myceliophthora thermophila* cell. In a most preferred embodiment, the filamentous fungal host cell is a *Mucor miehei* cell. In a most preferred embodiment, the filamentous fungal host cell is a *Neurospora crassa* cell. In a most preferred embodiment, the filamentous fungal host cell is a *Penicillium purpurogenum* cell. In another most preferred embodiment, the filamentous fungal host cell is a *Thielavia terrestris* cell. In another most preferred embodiment, the *Trichoderma* cell is a *Trichoderma reesei* cell, a *Trichoderma viride* cell, a *Trichoderma longibrachiatum* cell, a *Trichoderma harzianum* cell, or a *Trichoderma koningii* cell. In a preferred embodiment, the fungal host cell is selected from an *A. nidulans* cell, an *A. niger* cell, an *A. oryzae* cell and an *A. sojae* cell. In a further preferred embodiment, the fungal host cell is an *A. nidulans* cell.

The recombinant fungal host cells of the present invention may further comprise one or more sequences which encode one or more factors that are advantageous in the expression of the protein or fragment thereof, for example, an activator (e.g., a trans-acting factor), a chaperone and a processing protease. The nucleic acids encoding one or more of these factors are preferably not operably linked to the nucleic acid encoding the protein or fragment thereof. An activator is a protein which activates transcription of a nucleic acid sequence encoding a polypeptide (Kudla et al., *EMBO* 9:1355-1364 (1990); Jarai and Buxton, *Current Genetics* 26:2238-244 (1994); Verdier, *Yeast* 6:271-297 (1990), all of which are herein incorporated by reference in their entirety). The nucleic acid sequence encoding an activator may be obtained from the genes encoding *Saccharomyces cerevisiae* heme activator protein 1 (hap1), *Saccharomyces cerevisiae* galactose metabolizing protein 4 (gal4) and *Aspergillus nidulans* ammonia regulation protein (areA). For further examples, see Verdier, *Yeast* 6:271-297 (1990); MacKenzie et al., *Journal of Gen. Microbiol.* 139:2295-2307 (1993), both of which are herein incorporated by reference in their entirety). A chaperone is a protein which assists another protein in folding properly (Hartl et al., *TIBS* 19:20-25 (1994); Bergeron et al., *TIBS* 19:124-128 (1994); Demolder et al., *J. Biotechnology* 32:179-189 (1994); Craig, *Science* 260:1902-1903 (1993); Gething and Sambrook, *Nature* 355:33-45 (1992); Puig and Gilbert, *J. Biol. Chem.* 269:7764-7771 (1994); Wang and Tsou, *FASEB Journal* 7:1515-11157 (1993); Robinson et al., *Bio/Technology* 1:381-384 (1994), all of which are herein incorporated by reference in their entirety). The nucleic acid sequence encoding a chaperone may be obtained from the genes encoding *Aspergillus oryzae* protein disulphide isomerase, *Saccharomyces cerevisiae* calnexin, *Saccharomyces cerevisiae* BiP/GRP78 and *Saccharomyces cerevisiae* Hsp70. For further examples, see Gething and Sambrook, *Nature* 355:33-45 (1992); Hartl et al., *TIBS* 19:20-25 (1994). A processing protease is a protease that cleaves a propeptide to generate a mature biochemically active polypeptide (Enderlin and Ogrydziak, *Yeast* 10:67-79 (1994); Fuller et al., *Proc. Natl. Acad. Sci. (U.S.A.)* 86:1434-1438 (1989); Julius et al., *Cell* 37:1075-1089 (1984); Julius et al., *Cell* 32:839-852 (1983), all of which are incorporated by reference in their entirety). The nucleic acid sequence encoding a processing protease may be obtained from the genes encoding *Aspergillus niger* Kex2, *Saccharomyces cerevisiae* dipeptidylaminopeptidase, *Saccharomyces cerevisiae* Kex2 and *Yarrowia lipolytica* dibasic processing endoprotease (xpr6). Any factor that is functional in the fungal host cell of choice may be used in the present invention.

Fungal cells may be transformed by a process involving protoplast formation, transformation of the protoplasts and regeneration of the cell wall in a manner known per se. Suitable procedures for transformation of *Aspergillus* host cells are described in EP 238 023 and Yelton et al., *Proc. Natl. Acad. Sci. (U.S.A.)* 81:1470-1474 (1984), both of which are herein incorporated by reference in their entirety. A suitable method of transforming *Fusarium* species is described by Malardier et al., *Gene* 78:147-156 (1989), the entirety of which is herein incorporated by reference. Yeast may be transformed using the procedures described by Becker and Guarente, In: Abelson and Simon, (eds.), *Guide to Yeast Genetics and Molecular Biology, Methods Enzymol.* Volume 194, pp 182-187, Academic Press, Inc., New York; Ito et al., *J. Bacteriology* 153:163 (1983); Hinnen et al., *Proc. Natl. Acad. Sci.* (*U.S.A.*) 75:1920 (1978), all of which are herein incorporated by reference in their entirety.

The present invention also relates to methods of producing the protein or fragment thereof comprising culturing the recombinant fungal host cells under conditions conducive for expression of the protein or fragment thereof. The fungal cells of the present invention are cultivated in a nutrient medium suitable for production of the protein or fragment thereof using methods known in the art. For example, the cell may be cultivated by shake flask cultivation, small-scale or large-scale fermentation (including continuous, batch, fed-batch, or solid state fermentations) in laboratory or industrial fermentors performed in a suitable medium and under conditions allowing the protein or fragment thereof to be expressed and/or isolated. The cultivation takes place in a suitable nutrient medium comprising carbon and nitrogen sources and inorganic salts, using procedures known in the art (see, e.g., Bennett and LaSure (eds.), *More Gene Manipulations in Fungi*, Academic Press, CA, (1991), the entirety of which is herein incorporated by reference). Suitable media are available from commercial suppliers or may be prepared according to published compositions (e.g., in catalogues of the American Type Culture Collection, Manassas, Va.). If the protein or fragment thereof is secreted into the nutrient medium, a protein or fragment thereof can be recovered directly from the medium. If the protein or fragment thereof is not secreted, it is recovered from cell lysates.

The expressed protein or fragment thereof may be detected using methods known in the art that are specific for the particular protein or fragment. These detection methods may include the use of specific antibodies, formation of an enzyme product, or disappearance of an enzyme substrate. For example, if the protein or fragment thereof has enzymatic activity, an enzyme assay may be used. Alternatively, if polyclonal or monoclonal antibodies specific to the protein or fragment thereof are available, immunoassays may be employed using the antibodies to the protein or fragment thereof. The techniques of enzyme assay and immunoassay are well known to those skilled in the art.

The resulting protein or fragment thereof may be recovered by methods known in the arts. For example, the protein or fragment thereof may be recovered from the nutrient medium by conventional procedures including, but not limited to, centrifugation, filtration, extraction, spray-drying, evaporation, or precipitation. The recovered protein or fragment thereof may then be further purified by a variety of chromatographic procedures, e.g., ion exchange chromatography, gel filtration chromatography, affinity chromatography, or the like.

(c) Mammalian Constructs and Transformed Mammalian Cells

The present invention also relates to methods for obtaining a recombinant mammalian host cell, comprising introducing into a mammalian host cell exogenous genetic material. The present invention also relates to a mammalian cell comprising a mammalian recombinant vector. The present invention also relates to methods for obtaining a recombinant mammalian host cell, comprising introducing into a mammalian cell exogenous genetic material.

Mammalian cell lines available as hosts for expression are known in the art and include many immortalized cell lines available from the American Type Culture Collection (ATCC, Manassas, Va.), such as HeLa cells, Chinese hamster ovary (CHO) cells, baby hamster kidney (BHK) cells and a number of other cell lines. Suitable promoters for mammalian cells are also known in the art and include viral promoters such as that from Simian Virus 40 (SV40) (Fiers et al., *Nature* 273: 113 (1978), the entirety of which is herein incorporated by reference), Rous sarcoma virus (RSV), adenovirus (ADV) and bovine papilloma virus (BPV). Mammalian cells may also require terminator sequences and poly-A addition sequences. Enhancer sequences which increase expression may also be included and sequences which promote amplification of the gene may also be desirable (for example methotrexate resistance genes).

Vectors suitable for replication in mammalian cells may include viral replicons, or sequences which insure integration of the appropriate sequences encoding HCV epitopes into the host genome. For example, another vector used to express foreign DNA is vaccinia virus. In this case, for example, a nucleic acid molecule encoding a protein or fragment thereof is inserted into the vaccinia genome. Techniques for the insertion of foreign DNA into the vaccinia virus genome are known in the art and may utilize, for example, homologous recombination. Such heterologous DNA is generally inserted into a gene which is non-essential to the virus, for example, the thymidine kinase gene (tk), which also provides a selectable marker. Plasmid vectors that greatly facilitate the construction of recombinant viruses have been described (see, for example, Mackett et al., *J Virol.* 49:857 (1984); Chakrabarti et al., *Mol. Cell. Biol.* 5:3403 (1985); Moss, In: *Gene Transfer Vectors For Mammalian Cells* (Miller and Calos, eds., Cold Spring Harbor Laboratory, N.Y., p. 10, (1987); all of which are herein incorporated by reference in their entirety). Expression of the HCV polypeptide then occurs in cells or animals which are infected with the live recombinant vaccinia virus.

The sequence to be integrated into the mammalian sequence may be introduced into the primary host by any convenient means, which includes calcium precipitated DNA, spheroplast fusion, transformation, electroporation, biolistics, lipofection, microinjection, or other convenient means. Where an amplifiable gene is being employed, the amplifiable gene may serve as the selection marker for selecting hosts into which the amplifiable gene has been introduced. Alternatively, one may include with the amplifiable gene another marker, such as a drug resistance marker, e.g. neomycin resistance (G418 in mammalian cells), hygromycin in resistance etc., or an auxotrophy marker (HIS3, TRP1, LEU2, URA3, ADE2, LYS2, etc.) for use in yeast cells.

Depending upon the nature of the modification and associated targeting construct, various techniques may be employed for identifying targeted integration. Conveniently, the DNA may be digested with one or more restriction enzymes and the fragments probed with an appropriate DNA fragment which will identify the properly sized restriction fragment associated with integration.

One may use different promoter sequences, enhancer sequences, or other sequence which will allow for enhanced levels of expression in the expression host. Thus, one may combine an enhancer from one source, a promoter region from another source, a 5'-noncoding region upstream from the initiation methionine from the same or different source as the other sequences and the like. One may provide for an intron in the non-coding region with appropriate splice sites or for an alternative 3'-untranslated sequence or polyadenylation site. Depending upon the particular purpose of the modification, any of these sequences may be introduced, as desired.

Where selection is intended, the sequence to be integrated will have with it a marker gene, which allows for selection. The marker gene may conveniently be downstream from the target gene and may include resistance to a cytotoxic agent, e.g. antibiotics, heavy metals, or the like, resistance or susceptibility to HAT, gancyclovir, etc., complementation to an auxotrophic host, particularly by using an auxotrophic yeast as the host for the subject manipulations, or the like. The marker gene may also be on a separate DNA molecule, particularly with primary mammalian cells. Alternatively, one may screen the various transformants, due to the high efficiency of recombination in yeast, by using hybridization analysis, PCR, sequencing, or the like.

For homologous recombination, constructs can be prepared where the amplifiable gene will be flanked, normally on both sides with DNA homologous with the DNA of the target region. Depending upon the nature of the integrating DNA and the purpose of the integration, the homologous DNA will generally be within 100 kb, usually 50 kb, preferably about 25 kb, of the transcribed region of the target gene, more preferably within 2 kb of the target gene. Where modeling of the gene is intended, homology will usually be present proximal to the site of the mutation. The homologous DNA may include the 5'-upstream region outside of the transcriptional regulatory region or comprising any enhancer sequences, transcriptional initiation sequences, adjacent sequences, or the like. The homologous region may include a portion of the coding region, where the coding region may be comprised only of an open reading frame or combination of exons and introns. The homologous region may comprise all or a portion of an intron, where all or a portion of one or more exons may also be present. Alternatively, the homologous region may comprise the 3'-region, so as to comprise all or a portion of the transcriptional termination region, or the region 3' of this region. The homologous regions may extend over all or a portion of the target gene or be outside the target gene comprising all or a portion of the transcriptional regulatory regions and/or the structural gene.

The integrating constructs may be prepared in accordance with conventional ways, where sequences may be synthesized, isolated from natural sources, manipulated, cloned, ligated, subjected to in vitro mutagenesis, primer repair, or the like. At various stages, the joined sequences may be cloned and analyzed by restriction analysis, sequencing, or the like. Usually during the preparation of a construct where various fragments are joined, the fragments, intermediate constructs and constructs will be carried on a cloning vector comprising a replication system functional in a prokaryotic host, e.g., *E. coli* and a marker for selection, e.g., biocide resistance, complementation to an auxotrophic host, etc. Other functional sequences may also be present, such as polylinkers, for ease of introduction and excision of the construct or portions thereof, or the like. A large number of cloning vectors are available such as pBR322, the pUC series, etc. These constructs may then be used for integration into the primary mammalian host.

In the case of the primary mammalian host, a replicating vector may be used. Usually, such vector will have a viral replication system, such as SV40, bovine papilloma virus, adenovirus, or the like. The linear DNA sequence vector may also have a selectable marker for identifying transfected cells. Selectable markers include the neo gene, allowing for selection with G418, the herpes tk gene for selection with HAT medium, the gpt gene with mycophenolic acid, complementation of an auxotrophic host, etc.

The vector may or may not be capable of stable maintenance in the host. Where the vector is capable of stable maintenance, the cells will be screened for homologous integration of the vector into the genome of the host, where various techniques for curing the cells may be employed. Where the vector is not capable of stable maintenance, for example, where a temperature sensitive replication system is employed, one may change the temperature from the permissive temperature to the non-permissive temperature, so that the cells may be cured of the vector. In this case, only those cells having integration of the construct comprising the amplifiable gene and, when present, the selectable marker, will be able to survive selection.

Where a selectable marker is present, one may select for the presence of the targeting construct by means of the selectable marker. Where the selectable marker is not present, one may select for the presence of the construct by the amplifiable gene. For the neo gene or the herpes tk gene, one could employ a medium for growth of the transformants of about 0.1-1 mg/ml of G418 or may use HAT medium, respectively. Where DHFR is the amplifiable gene, the selective medium may include from about 0.01-0.5 µM of methotrexate or be deficient in glycine-hypoxanthine-thymidine and have dialysed serum (GHT media).

The DNA can be introduced into the expression host by a variety of techniques that include calcium phosphate/DNA co-precipitates, microinjection of DNA into the nucleus, electroporation, yeast protoplast fusion with intact cells, transfection, polycations, e.g., polybrene, polyornithine, etc., or the like. The DNA may be single or double stranded DNA, linear or circular. The various techniques for transforming mammalian cells are well known (see Keown et al., *Methods Enzymol.* (1989); Keown et al., *Methods Enzymol.* 185:527-537 (1990); Mansour et al., *Nature* 336:348-352, (1988); all of which are herein incorporated by reference in their entirety).

(d) Insect Constructs and Transformed Insect Cells

The present invention also relates to an insect recombinant vectors comprising exogenous genetic material. The present invention also relates to an insect cell comprising an insect recombinant vector. The present invention also relates to methods for obtaining a recombinant insect host cell, comprising introducing into an insect cell exogenous genetic material.

The insect recombinant vector may be any vector which can be conveniently subjected to recombinant DNA procedures and can bring about the expression of the nucleic acid sequence. The choice of a vector will typically depend on the compatibility of the vector with the insect host cell into which the vector is to be introduced. The vector may be a linear or a closed circular plasmid. The vector system may be a single vector or plasmid or two or more vectors or plasmids which together contain the total DNA to be introduced into the genome of the insect host. In addition, the insect vector may be an expression vector. Nucleic acid molecules can be suitably inserted into a replication vector for expression in the insect cell under a suitable promoter for insect cells. Many vectors are available for this purpose and selection of the appropriate vector will depend mainly on the size of the nucleic acid molecule to be inserted into the vector and the particular host cell to be transformed with the vector. Each vector contains various components depending on its function (amplification of DNA or expression of DNA) and the particular host cell with which it is compatible. The vector components for insect cell transformation generally include, but are not limited to, one or more of the following: a signal sequence, origin of replication, one or more marker genes and an inducible promoter.

The insect vector may be an autonomously replicating vector, i.e., a vector which exists as an extrachromosomal entity, the replication of which is independent of chromosomal replication, e.g., a plasmid, an extrachromosomal element, a minichromosome, or an artificial chromosome. The vector may contain any means for assuring self-replication. Alternatively, the vector may be one which, when introduced into the insect cell, is integrated into the genome and replicated together with the chromosome(s) into which it has been integrated. For integration, the vector may rely on the nucleic acid sequence of the vector for stable integration of the vector into the genome by homologous or nonhomologous recombination. Alternatively, the vector may contain additional nucleic acid sequences for directing integration by homologous recombination into the genome of the insect host. The additional nucleic acid sequences enable the vector to be integrated into the host cell genome at a precise location(s) in the chromosome(s). To increase the likelihood of integration at a precise location, there should be preferably two nucleic acid sequences which individually contain a sufficient number of nucleic acids, preferably 400 bp to 1500 bp, more preferably 800 bp to 1000 bp, which are highly homologous with the corresponding target sequence to enhance the probability of homologous recombination. These nucleic acid sequences may be any sequence that is homologous with a target sequence in the genome of the insect host cell and, furthermore, may be non-encoding or encoding sequences.

Baculovirus expression vectors (BEVs) have become important tools for the expression of foreign genes, both for basic research and for the production of proteins with direct clinical applications in human and veterinary medicine (Doerfler, *Curr. Top. Microbiol. Immunol.* 131:51-68 (1968); Luckow and Summers, *Bio/Technology* 6:47-55 (1988a); Miller, *Annual Review of Microbiol.* 42:177-199 (1988); Summers, *Curr. Comm. Molecular Biology*, Cold Spring Harbor Press, Cold Spring Harbor, N.Y. (1988); all of which are herein incorporated by reference in their entirety). BEVs are recombinant insect viruses in which the coding sequence for a chosen foreign gene has been inserted behind a baculovirus promoter in place of the viral gene, e.g., polyhedrin (Smith and Summers, U.S. Pat. No. 4,745,051, the entirety of which is incorporated herein by reference).

The use of baculovirus vectors relies upon the host cells being derived from Lepidopteran insects such as *Spodoptera frugiperda* or *Trichoplusia ni*. The preferred *Spodoptera frugiperda* cell line is the cell line Sf9. The *Spodoptera frugiperda* Sf9 cell line was obtained from American Type Culture Collection (Manassas, Va.) and is assigned accession number ATCC CRL 1711 (Summers and Smith, *A Manual of Methods for Baculovirus Vectors and Insect Cell Culture Procedures*, Texas Ag. Exper. Station Bulletin No. 1555 (1988), the entirety of which is herein incorporated by reference). Other insect cell systems, such as the silkworm *B. mori* may also be used.

The proteins expressed by the BEVs are, therefore, synthesized, modified and transported in host cells derived from *Lepidopteran* insects. Most of the genes that have been inserted and produced in the baculovirus expression vector system have been derived from vertebrate species. Other baculovirus genes in addition to the polyhedrin promoter may be employed to advantage in a baculovirus expression system. These include immediate-early (alpha), delayed-early (β), late (γ), or very late (delta), according to the phase of the viral infection during which they are expressed. The expression of these genes occurs sequentially, probably as the result of a "cascade" mechanism of transcriptional regulation. (Guarino and Summers, *J. Virol.* 57:563-571 (1986); Guarino and Summers, *J. Virol.* 61:2091-2099 (1987); Guarino and Summers, *Virol.* 162:444-451 (1988); all of which are herein incorporated by reference in their entirety).

Insect recombinant vectors are useful as intermediates for the infection or transformation of insect cell systems. For example, an insect recombinant vector containing a nucleic acid molecule encoding a baculovirus transcriptional promoter followed downstream by an insect signal DNA sequence is capable of directing the secretion of the desired biologically active protein from the insect cell. The vector may utilize a baculovirus transcriptional promoter region derived from any of the over 500 baculoviruses generally infecting insects, such as for example the Orders *Lepidoptera, Diptera, Orthoptera, Coleoptera* and *Hymenoptera*, including for example but not limited to the viral DNAs of *Autographa californica* MNPV, *Bombyx mori* NPV, *Trichoplusia ni* MNPV, *Rachiplusia ou* MNPV or *Galleria mellonella* MNPV, wherein said baculovirus transcriptional promoter is a baculovirus immediate-early gene IEI or IEN promoter; an immediate-early gene in combination with a baculovirus delayed-early gene promoter region selected from the group consisting of 39K and a HindIII-k fragment delayed-early gene; or a baculovirus late gene promoter. The immediate-early or delayed-early promoters can be enhanced with transcriptional enhancer elements. The insect signal DNA sequence may code for a signal peptide of a *Lepidopteran* adipokinetic hormone precursor or a signal peptide of the *Manduca sexta* adipokinetic hormone precursor (Summers, U.S. Pat. No. 5,155,037; the entirety of which is herein incorporated by reference). Other insect signal DNA sequences include a signal peptide of the *Orthoptera Schistocerca gregaria* locust adipokinetic hormone precurser and the *Drosophila melanogaster* cuticle genes CP1, CP2, CP3 or CP4 or for an insect signal peptide having substantially a similar chemical composition and function (Summers, U.S. Pat. No. 5,155,037).

Insect cells are distinctly different from animal cells. Insects have a unique life cycle and have distinct cellular properties such as the lack of intracellular plasminogen activators in which are present in vertebrate cells. Another difference is the high expression levels of protein products ranging from 1 to greater than 500 mg/liter and the ease at which cDNA can be cloned into cells (Frasier, *In Vitro Cell. Dev. Biol.* 25:225 (1989); Summers and Smith, In: *A Manual of Methods for Baculovirus Vectors and Insect Cell Culture Procedures*, Texas Ag. Exper. Station Bulletin No. 1555 (1988), both of which are incorporated by reference in their entirety).

Recombinant protein expression in insect cells is achieved by viral infection or stable transformation. For viral infection, the desired gene is cloned into baculovirus at the site of the wild-type polyhedron gene (Webb and Summers, *Technique* 2:173 (1990); Bishop and Posse, *Adv. Gene Technol.* 1:55 (1990); both of which are incorporated by reference in their entirety). The polyhedron gene is a component of a protein coat in occlusions which encapsulate virus particles. Deletion or insertion in the polyhedron gene results the failure to form occlusion bodies. Occlusion negative viruses are morphologically different from occlusion positive viruses and enable one skilled in the art to identify and purify recombinant viruses.

The vectors of present invention preferably contain one or more selectable markers which permit easy selection of transformed cells. A selectable marker is a gene the product of which provides, for example biocide or viral resistance, resistance to heavy metals, prototrophy to auxotrophs and the like. Selection may be accomplished by co-transformation, e.g., as described in WO 91/17243, a nucleic acid sequence of the present invention may be operably linked to a suitable promoter sequence. The promoter sequence is a nucleic acid sequence which is recognized by the insect host cell for expression of the nucleic acid sequence. The promoter sequence contains transcription and translation control sequences which mediate the expression of the protein or fragment thereof. The promoter may be any nucleic acid sequence which shows transcriptional activity in the insect host cell of choice and may be obtained from genes encoding polypeptides either homologous or heterologous to the host cell.

For example, a nucleic acid molecule encoding a protein or fragment thereof may also be operably linked to a suitable leader sequence. A leader sequence is a nontranslated region of a mRNA which is important for translation by the fungal host. The leader sequence is operably linked to the 5' terminus of the nucleic acid sequence encoding the protein or fragment thereof. The leader sequence may be native to the nucleic acid sequence encoding the protein or fragment thereof or may be obtained from foreign sources. Any leader sequence which is functional in the insect host cell of choice may be used in the present invention.

A polyadenylation sequence may also be operably linked to the 3' terminus of the nucleic acid sequence of the present invention. The polyadenylation sequence is a sequence which when transcribed is recognized by the insect host to add polyadenosine residues to transcribed mRNA. The polyadenylation sequence may be native to the nucleic acid sequence encoding the protein or fragment thereof or may be obtained from foreign sources. Any polyadenylation sequence which is functional in the fungal host of choice may be used in the present invention.

To avoid the necessity of disrupting the cell to obtain the protein or fragment thereof and to minimize the amount of possible degradation of the expressed polypeptide within the cell, it is preferred that expression of the polypeptide gene gives rise to a product secreted outside the cell. To this end, the protein or fragment thereof of the present invention may be linked to a signal peptide linked to the amino terminus of the protein or fragment thereof. A signal peptide is an amino acid sequence which permits the secretion of the protein or fragment thereof from the insect host into the culture medium. The signal peptide may be native to the protein or fragment thereof of the invention or may be obtained from foreign sources. The 5' end of the coding sequence of the nucleic acid sequence of the present invention may inherently contain a signal peptide coding region naturally linked in translation reading frame with the segment of the coding region which encodes the secreted protein or fragment thereof.

At present, a mode of achieving secretion of a foreign gene product in insect cells is by way of the foreign gene's native signal peptide. Because the foreign genes are usually from non-insect organisms, their signal sequences may be poorly recognized by insect cells and hence, levels of expression may be suboptimal. However, the efficiency of expression of foreign gene products seems to depend primarily on the characteristics of the foreign protein. On average, nuclear localized or non-structural proteins are most highly expressed, secreted proteins are intermediate and integral membrane proteins are the least expressed. One factor generally affecting the efficiency of the production of foreign gene products in a heterologous host system is the presence of native signal sequences (also termed presequences, targeting signals, or leader sequences) associated with the foreign gene. The signal sequence is generally coded by a DNA sequence immediately following (5' to 3') the translation start site of the desired foreign gene.

The expression dependence on the type of signal sequence associated with a gene product can be represented by the following example: If a foreign gene is inserted at a site downstream from the translational start site of the baculovirus polyhedrin gene so as to produce a fusion protein (containing the N-terminus of the polyhedrin structural gene), the fused gene is highly expressed. But less expression is achieved when a foreign gene is inserted in a baculovirus expression vector immediately following the transcriptional start site and totally replacing the polyhedrin structural gene.

Insertions into the region −50 to −1 significantly alter (reduce) steady state transcription which, in turn, reduces translation of the foreign gene product. Use of the pVL941 vector optimizes transcription of foreign genes to the level of the polyhedrin gene transcription. Even though the transcription of a foreign gene may be optimal, optimal translation may vary because of several factors involving processing: signal peptide recognition, mRNA and ribosome binding, glycosylation, disulfide bond formation, sugar processing, oligomerization, for example.

The properties of the insect signal peptide are expected to be more optimal for the efficiency of the translation process in insect cells than those from vertebrate proteins. This phenomenon can generally be explained by the fact that proteins secreted from cells are synthesized as precursor molecules containing hydrophobic N-terminal signal peptides. The signal peptides direct transport of the select protein to its target membrane and are then cleaved by a peptidase on the membrane, such as the endoplasmic reticulum, when the protein passes through it.

Another exemplary insect signal sequence is the sequence encoding for *Drosophila* cuticle proteins such as CP1, CP2, CP3 or CP4 (Summers, U.S. Pat. No. 5,278,050; the entirety of which is herein incorporated by reference). Most of a 9 kb region of the *Drosophila* genome containing genes for the cuticle proteins has been sequenced. Four of the five cuticle genes contains a signal peptide coding sequence interrupted by a short intervening sequence (about 60 base pairs) at a conserved site. Conserved sequences occur in the 5' mRNA untranslated region, in the adjacent 35 base pairs of upstream flanking sequence and at −200 base pairs from the mRNA start position in each of the cuticle genes.

Standard methods of insect cell culture, cotransfection and preparation of plasmids are set forth in Summers and Smith (Summers and Smith, *A Manual of Methods for Baculovirus Vectors and Insect Cell Culture Procedures*, Texas Agricultural Experiment Station Bulletin No. 1555, Texas A&M University (1987)). Procedures for the cultivation of viruses and cells are described in Volkman and Summers, *J. Virol* 19:820-832 (1975) and Volkman et al., *J. Virol* 19:820-832 (1976); both of which are herein incorporated by reference in their entirety.

(e) Bacterial Constructs and Transformed Bacterial Cells

The present invention also relates to a bacterial recombinant vector comprising exogenous genetic material. The present invention also relates to a bacteria cell comprising a bacterial recombinant vector. The present invention also relates to methods for obtaining a recombinant bacteria host cell, comprising introducing into a bacterial host cell exogenous genetic material.

The bacterial recombinant vector may be any vector which can be conveniently subjected to recombinant DNA procedures. The choice of a vector will typically depend on the compatibility of the vector with the bacterial host cell into which the vector is to be introduced. The vector may be a linear or a closed circular plasmid. The vector system may be a single vector or plasmid or two or more vectors or plasmids which together contain the total DNA to be introduced into the genome of the bacterial host. In addition, the bacterial vector may be an expression vector. Nucleic acid molecules encoding protein homologues or fragments thereof can, for example, be suitably inserted into a replicable vector for expression in the bacterium under the control of a suitable promoter for bacteria. Many vectors are available for this purpose and selection of the appropriate vector will depend mainly on the size of the nucleic acid to be inserted into the vector and the particular host cell to be transformed with the vector. Each vector contains various components depending on its function (amplification of DNA or expression of DNA) and the particular host cell with which it is compatible. The vector components for bacterial transformation generally include, but are not limited to, one or more of the following: a signal sequence, an origin of replication, one or more marker genes and an inducible promoter.

In general, plasmid vectors containing replicon and control sequences that are derived from species compatible with the host cell are used in connection with bacterial hosts. The vector ordinarily carries a replication site, as well as marking sequences that are capable of providing phenotypic selection in transformed cells. For example, $E.$ $coli$ is typically transformed using pBR322, a plasmid derived from an $E.$ $coli$ species (see, e.g., Bolivar et al., $Gene$ 2:95 (1977); the entirety of which is herein incorporated by reference). pBR322 contains genes for ampicillin and tetracycline resistance and thus provides easy means for identifying transformed cells. The pBR322 plasmid, or other microbial plasmid or phage, also generally contains, or is modified to contain, promoters that can be used by the microbial organism for expression of the selectable marker genes.

Nucleic acid molecules encoding protein or fragments thereof may be expressed not only directly, but also as a fusion with another polypeptide, preferably a signal sequence or other polypeptide having a specific cleavage site at the N-terminus of the mature polypeptide. In general, the signal sequence may be a component of the vector, or it may be a part of the polypeptide DNA that is inserted into the vector. The heterologous signal sequence selected should be one that is recognized and processed (i.e., cleaved by a signal peptidase) by the host cell. For bacterial host cells that do not recognize and process the native polypeptide signal sequence, the signal sequence is substituted by a bacterial signal sequence selected, for example, from the group consisting of the alkaline phosphatase, penicillinase, lpp, or heat-stable enterotoxin II leaders.

Both expression and cloning vectors contain a nucleic acid sequence that enables the vector to replicate in one or more selected host cells. Generally, in cloning vectors this sequence is one that enables the vector to replicate independently of the host chromosomal DNA and includes origins of replication or autonomously replicating sequences. Such sequences are well known for a variety of bacteria. The origin of replication from the plasmid pBR322 is suitable for most Gram-negative bacteria.

Expression and cloning vectors also generally contain a selection gene, also termed a selectable marker. This gene encodes a protein necessary for the survival or growth of transformed host cells grown in a selective culture medium. Host cells not transformed with the vector containing the selection gene will not survive in the culture medium. Typical selection genes encode proteins that (a) confer resistance to antibiotics or other toxins, e.g., ampicillin, neomycin, methotrexate, or tetracycline, (b) complement auxotrophic deficiencies, or (c) supply critical nutrients not available from complex media, e.g., the gene encoding D-alanine racemase for Bacilli. One example of a selection scheme utilizes a drug to arrest growth of a host cell. Those cells that are successfully transformed with a heterologous protein homologue or fragment thereof produce a protein conferring drug resistance and thus survive the selection regimen.

The expression vector for producing a protein or fragment thereof can also contains an inducible promoter that is recognized by the host bacterial organism and is operably linked to the nucleic acid encoding, for example, the nucleic acid molecule encoding the protein homologue or fragment thereof of interest. Inducible promoters suitable for use with bacterial hosts include the β-lactamase and lactose promoter systems (Chang et al., $Nature$ 275:615 (1978); Goeddel et al., $Nature$ 281:544 (1979); both of which are herein incorporated by reference in their entirety), the arabinose promoter system (Guzman et al., $J.$ $Bacteriol.$ 174:7716-7728 (1992); the entirety of which is herein incorporated by reference), alkaline phosphatase, a tryptophan (trp) promoter system (Goeddel, $Nucleic$ $Acids$ $Res.$ 8:4057 (1980); EP 36,776; both of which are herein incorporated by reference in their entirety) and hybrid promoters such as the tac promoter (deBoer et al., $Proc.$ $Natl.$ $Acad.$ $Sci.$ ($USA$) 80:21-25 (1983); the entirety of which is herein incorporated by reference). However, other known bacterial inducible promoters are suitable (Siebenlist et al., $Cell$ 20:269 (1980); the entirety of which is herein incorporated by reference).

Promoters for use in bacterial systems also generally contain a Shine-Dalgarno (S.D.) sequence operably linked to the DNA encoding the polypeptide of interest. The promoter can be removed from the bacterial source DNA by restriction enzyme digestion and inserted into the vector containing the desired DNA.

Construction of suitable vectors containing one or more of the above-listed components employs standard ligation techniques. Isolated plasmids or DNA fragments are cleaved, tailored and re-ligated in the form desired to generate the plasmids required. Examples of available bacterial expression vectors include, but are not limited to, the multifunctional $E.$ $coli$ cloning and expression vectors such as Bluescript™ (Stratagene, La Jolla, Calif.), in which, for example, encoding an $A.$ $nidulans$ protein homologue or fragment thereof homologue, may be ligated into the vector in frame with sequences for the amino-terminal Met and the subsequent 7 residues of β-galactosidase so that a hybrid protein is produced; pIN vectors (Van Heeke and Schuster, $J.$ $Biol.$ $Chem.$ 264:5503-5509 (1989), the entirety of which is herein incorporated by reference); and the like. pGEX vectors (Promega, Madison Wis. U.S.A.) may also be used to express foreign polypeptides as fusion proteins with glutathione S-transferase (GST). In general, such fusion proteins are soluble and can easily be purified from lysed cells by adsorption to glutathione-agarose beads followed by elution in the presence of free glutathione. Proteins made in such systems are designed to include heparin, thrombin or factor XA protease cleavage sites so that the cloned polypeptide of interest can be released from the GST moiety at will.

Suitable host bacteria for a bacterial vector include archaebacteria and eubacteria, especially eubacteria and most preferably Enterobacteriaceae. Examples of useful bacteria include $Escherichia,$ $Enterobacter,$ $Azotobacter,$ $Erwinia,$ $Bacillus,$ $Pseudomonas,$ $Klebsiella,$ $Proteus,$ $Salmonella,$ $Serratia,$ $Shigella,$ $Rhizobia,$ $Vitreoscilla$ and $Paracoccus.$ Suitable $E.$ $coli$ hosts include $E.$ $coli$ W3110 (American Type Culture Collection (ATCC) 27,325, Manassas, Va. U.S.A.), $E.$ $coli$ 294 (ATCC 31,446), $E.$ $coli$ B and $E.$ $coli$ X1776 (ATCC 31,537). These examples are illustrative rather than limiting. Mutant cells of any of the above-mentioned bacteria may also be employed. It is, of course, necessary to select the appropriate bacteria taking into consideration replicability of the replicon in the cells of a bacterium. For example, *E. coli, Serratia,* or *Salmonella* species can be suitably used as the host when well known plasmids such as pBR322, pBR325, pACYC177, or pKN410 are used to supply the replicon. *E. coli* strain W3110 is a preferred host or parent host because it is a common host strain for recombinant DNA product fermentations. Preferably, the host cell should secrete minimal amounts of proteolytic enzymes.

Host cells are transfected and preferably transformed with the above-described vectors and cultured in conventional nutrient media modified as appropriate for inducing promoters, selecting transformants, or amplifying the genes encoding the desired sequences.

Numerous methods of transfection are known to the ordinarily skilled artisan, for example, calcium phosphate and electroporation. Depending on the host cell used, transformation is done using standard techniques appropriate to such cells. The calcium treatment employing calcium chloride, as described in section 1.82 of Sambrook et al., *Molecular Cloning: A Laboratory Manual*, New York: Cold Spring Harbor Laboratory Press, (1989), is generally used for bacterial cells that contain substantial cell-wall barriers. Another method for transformation employs polyethylene glycol/DMSO, as described in Chung and Miller (Chung and Miller, *Nucleic Acids Res.* 16:3580 (1988); the entirety of which is herein incorporated by reference). Yet another method is the use of the technique termed electroporation.

Bacterial cells used to produce the polypeptide of interest for purposes of this invention are cultured in suitable media in which the promoters for the nucleic acid encoding the heterologous polypeptide can be artificially induced as described generally, e.g., in Sambrook et al., *Molecular Cloning: A Laboratory Manual*, New York: Cold Spring Harbor Laboratory Press, (1989). Examples of suitable media are given in U.S. Pat. Nos. 5,304,472 and 5,342,763; both of which are incorporated by reference in their entirety.

In addition to the above discussed procedures, practitioners are familiar with the standard resource materials which describe specific conditions and procedures for the construction, manipulation and isolation of macromolecules (e.g., DNA molecules, plasmids, etc.), generation of recombinant organisms and the screening and isolating of clones, (see for example, Sambrook et al., *Molecular Cloning: A Laboratory Manual*, Cold Spring Harbor Press (1989); Mailga et al., *Methods in Plant Molecular Biology*, Cold Spring Harbor Press (1995), the entirety of which is herein incorporated by reference; Birren et al., *Genome Analysis: Analyzing DNA*, 1, Cold Spring Harbor, N.Y., the entirety of which is herein incorporated by reference).

(f) Computer Readable Media

The nucleotide sequence provided in SEQ ID NO: 1 through SEQ ID NO: 3204 or fragment thereof, or complement thereof, or a nucleotide sequence at least 90% identical, preferably 95%, identical even more preferably 99% or 100% identical to the sequence provided in SEQ ID NO: 1 through SEQ ID NO: 3204 or fragment thereof, or complement thereof, can be "provided" in a variety of mediums to facilitate use. Such a medium can also provide a subset thereof in a form that allows a skilled artisan to examine the sequences.

A preferred subset of nucleotide sequences are those nucleic acid sequences that encode a maize or soybean methionine adenosyltransferase enzyme or complement thereof or fragment of either, a nucleic acid molecule that encodes a maize or soybean S-adenosylmethionine decarboxylase enzyme or complement thereof or fragment of either, a nucleic acid molecule that encodes a maize or soybean aspartate kinase enzyme or complement thereof or fragment of either, a nucleic acid molecule that encodes a maize or soybean aspartate-semialdehyde dehydrogenase enzyme or complement thereof or fragment of either, a nucleic acid molecule that encodes a maize or soybean O-succinylhomoserine (thiol)-lyase enzyme or complement thereof or fragment of either, a nucleic acid molecule that encodes a maize or soybean cystathionine β-lyase enzyme or complement thereof or fragment of either, a nucleic acid molecule that encodes a maize or soybean 5-methyltetrahydropteroyltriglutamate-homocysteine-S-methyltransferase enzyme or complement thereof or fragment of either, a nucleic acid molecule that encodes a maize or a soybean adenosylhomocysteinase enzyme or complement thereof or fragment of either, a nucleic acid molecule that encodes a maize or a soybean cystathionine β-synthase enzyme or complement thereof or fragment of either, a nucleic acid molecule that encodes a maize or a soybean cytsathionine γ-lyase enzyme or complement thereof or fragment of either and a nucleic acid molecule that encodes a maize or a soybean O-acetylhomoserine (thiol)-lyase enzyme or complement thereof or fragment of either.

A further preferred subset of nucleic acid sequences is where the subset of sequences is two proteins or fragments thereof, more preferably three proteins or fragments thereof and even more preferable four proteins or fragments thereof, these nucleic acid sequences are selected from the group that comprises a maize or soybean methionine adenosyltransferase enzyme or complement thereof or fragment of either, a nucleic acid molecule that encodes a maize or soybean S-adenosylmethionine decarboxylase enzyme or complement thereof or fragment of either, a nucleic acid molecule that encodes a maize or soybean aspartate kinase enzyme or complement thereof or fragment of either, a nucleic acid molecule that encodes a maize or soybean aspartate-semialdehyde dehydrogenase enzyme or complement thereof or fragment of either, a nucleic acid molecule that encodes a maize or soybean O-succinylhomoserine (thiol)-lyase enzyme or complement thereof or fragment of either, a nucleic acid molecule that encodes a maize or soybean cystathionine β-lyase enzyme or complement thereof or fragment of either, a nucleic acid molecule that encodes a maize or soybean 5-methyltetrahydropteroyltriglutamate-homocysteine-S-methyltransferase enzyme or complement thereof or fragment of either, a nucleic acid molecule that encodes a maize or a soybean adenosylhomocysteinase enzyme or complement thereof or fragment of either, a nucleic acid molecule that encodes a maize or a soybean cystathionine β-synthase enzyme or complement thereof or fragment of either, a nucleic acid molecule that encodes a maize or a soybean cytsathionine γ-lyase enzyme or complement thereof or fragment of either and a nucleic acid molecule that encodes a maize or a soybean O-acetylhomoserine (thiol)-lyase enzyme or complement thereof or fragment of either.

In one application of this embodiment, a nucleotide sequence of the present invention can be recorded on computer readable media. As used herein, "computer readable media" refers to any medium that can be read and accessed directly by a computer. Such media include, but are not limited to: magnetic storage media, such as floppy discs, hard disc, storage medium and magnetic tape: optical storage media such as CD-ROM; electrical storage media such as RAM and ROM; and hybrids of these categories such as magnetic/optical storage media. A skilled artisan can readily appreciate how any of the presently known computer readable mediums can be used to create a manufacture comprising computer readable medium having recorded thereon a nucleotide sequence of the present invention.

As used herein, "recorded" refers to a process for storing information on computer readable medium. A skilled artisan can readily adopt any of the presently known methods for recording information on computer readable medium to generate media comprising the nucleotide sequence information of the present invention. A variety of data storage structures are available to a skilled artisan for creating a computer readable medium having recorded thereon a nucleotide sequence of the present invention. The choice of the data storage structure will generally be based on the means chosen to access the stored information. In addition, a variety of data processor programs and formats can be used to store the nucleotide sequence information of the present invention on computer readable medium. The sequence information can be represented in a word processing text file, formatted in commercially-available software such as WordPerfect and Microsoft Word, or represented in the form of an ASCII file, stored in a database application, such as DB2, Sybase, Oracle, or the like. A skilled artisan can readily adapt any number of data processor structuring formats (e.g. text file or database) in order to obtain computer readable medium having recorded thereon the nucleotide sequence information of the present invention.

By providing one or more of nucleotide sequences of the present invention, a skilled artisan can routinely access the sequence information for a variety of purposes. Computer software is publicly available which allows a skilled artisan to access sequence information provided in a computer readable medium. The examples which follow demonstrate how software which implements the BLAST (Altschul et al., *J. Mol. Biol.* 215:403-410 (1990), the entirety of which is herein incorporated by reference) and BLAZE (Brutlag et al., *Comp. Chem.* 17:203-207 (1993), the entirety of which is herein incorporated by reference) search algorithms on a Sybase system can be used to identify open reading frames (ORFs) within the genome that contain homology to ORFs or proteins from other organisms. Such ORFs are protein-encoding fragments within the sequences of the present invention and are useful in producing commercially important proteins such as enzymes used in amino acid biosynthesis, metabolism, transcription, translation, RNA processing, nucleic acid and a protein degradation, protein modification and DNA replication, restriction, modification, recombination and repair.

The present invention further provides systems, particularly computer-based systems, which contain the sequence information described herein. Such systems are designed to identify commercially important fragments of the nucleic acid molecule of the present invention. As used herein, "a computer-based system" refers to the hardware means, software means and data storage means used to analyze the nucleotide sequence information of the present invention. The minimum hardware means of the computer-based systems of the present invention comprises a central processing unit (CPU), input means, output means and data storage means. A skilled artisan can readily appreciate that any one of the currently available computer-based system are suitable for use in the present invention.

As indicated above, the computer-based systems of the present invention comprise a data storage means having stored therein a nucleotide sequence of the present invention and the necessary hardware means and software means for supporting and implementing a search means. As used herein, "data storage means" refers to memory that can store nucleotide sequence information of the present invention, or a memory access means which can access manufactures having recorded thereon the nucleotide sequence information of the present invention. As used herein, "search means" refers to one or more programs which are implemented on the computer-based system to compare a target sequence or target structural motif with the sequence information stored within the data storage means. Search means are used to identify fragments or regions of the sequence of the present invention that match a particular target sequence or target motif. A variety of known algorithms are disclosed publicly and a variety of commercially available software for conducting search means are available can be used in the computer-based systems of the present invention. Examples of such software include, but are not limited to, MacPattern (EMBL), BLASTIN and BLASTIX (NCBIA). One of the available algorithms or implementing software packages for conducting homology searches can be adapted for use in the present computer-based systems.

The most preferred sequence length of a target sequence is from about 10 to 100 amino acids or from about 30 to 300 nucleotide residues. However, it is well recognized that during searches for commercially important fragments of the nucleic acid molecules of the present invention, such as sequence fragments involved in gene expression and protein processing, may be of shorter length.

As used herein, "a target structural motif," or "target motif," refers to any rationally selected sequence or combination of sequences in which the sequences the sequence(s) are chosen based on a three-dimensional configuration which is formed upon the folding of the target motif. There are a variety of target motifs known in the art. Protein target motifs include, but are not limited to, enzymatic active sites and signal sequences. Nucleic acid target motifs include, but are not limited to, promoter sequences, cis elements, hairpin structures and inducible expression elements (protein binding sequences).

Thus, the present invention further provides an input means for receiving a target sequence, a data storage means for storing the target sequences of the present invention sequence identified using a search means as described above and an output means for outputting the identified homologous sequences. A variety of structural formats for the input and output means can be used to input and output information in the computer-based systems of the present invention. A preferred format for an output means ranks fragments of the sequence of the present invention by varying degrees of homology to the target sequence or target motif. Such presentation provides a skilled artisan with a ranking of sequences which contain various amounts of the target sequence or target motif and identifies the degree of homology contained in the identified fragment.

A variety of comparing means can be used to compare a target sequence or target motif with the data storage means to identify sequence fragments sequence of the present invention. For example, implementing software which implement the BLAST and BLAZE algorithms (Altschul et al., *J. Mol. Biol.* 215:403-410 (1990)) can be used to identify open frames within the nucleic acid molecules of the present invention. A skilled artisan can readily recognize that any one of the publicly available homology search programs can be used as the search means for the computer-based systems of the present invention.

Having now generally described the invention, the same will be more readily understood through reference to the following examples which are provided by way of illustration and are not intended to be limiting of the present invention, unless specified.

Example 1

The MONN01 cDNA library is a normalized library generated from maize (DK604, Dekalb Genetics, Dekalb, Ill. U.S.A.) total leaf tissue at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The older, more juvenile leaves, which are in a basal position, as well as the younger, more adult leaves, which are more apical are cut at the base of the leaves. The leaves are then pooled and immediately transferred to liquid nitrogen containers in which the pooled leaves are crushed. The harvested tissue is then stored at −80° C. until RNA preparation.

The SATMON001 cDNA library is generated from maize (B73, Illinois Foundation Seeds, Champaign, Ill. U.S.A.) immature tassels at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue from the maize plant is collected at the V6 stage. At that stage the tassel is an immature tassel of about 2-3 cm in length. The tassels are removed and frozen in liquid nitrogen. The harvested tissue is then stored at −80° C. until RNA preparation.

The SATMON003 library is generated from maize (B73 x Mo17, Illinois Foundation Seeds, Champaign, Ill. U.S.A.) roots at the V6 developmental stage. Seeds are planted at a depth of approximately 3 cm in coil into 2-3 inch peat pots containing Metro 200 growing medium. After 2-3 weeks growth, the seedlings are transplanted into 10 inch pots containing the Metro 200 growing medium. Plants are watered daily before transplantation and approximately 3 times a week after transplantation. Peters 15-16-17 fertilizer is applied approximately three times per week after transplanting at a concentration of 150 ppm N. Two to three times during the life time of the plant from transplanting to flowering a total of approximately 900 mg Fe is added to each pot. Maize plants are grown in the green house in approximately 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6 leaf development stage. The root system is cut from maize plant and washed with water to free it from the soil. The tissue is then immediately frozen in liquid nitrogen. The harvested tissue is then stored at −80° C. until RNA preparation.

The SATMON004 cDNA library is generated from maize (B73 x Mo17, Illinois Foundation Seeds, Champaign, Ill. U.S.A.) total leaf tissue at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The older, more juvenile leaves, which are in a basal position, as well as the younger, more adult leaves, which are more apical are cut at the base of the leaves. The leaves are then pooled and immediately transferred to liquid nitrogen containers in which the pooled leaves are crushed. The harvested tissue is then stored at −80° C. until RNA preparation.

The SATMON005 cDNA library is generated from maize (B73 x Mo17, Illinois Foundation Seeds, Champaign Ill., U.S.A.) root tissue at the V6 development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The root system is cut from the mature maize plant and washed with water to free it from the soil. The tissue is immediately frozen in liquid nitrogen and the harvested tissue is then stored at −80° C. until RNA preparation.

The SATMON006 cDNA library is generated from maize (B73 x Mo17, Illinois Foundation Seeds, Champaign Ill., U.S.A.) total leaf tissue at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The older more juvenile leaves, which are in a basal position, as well as the younger more adult leaves, which are more apical are cut at the base of the leaves. The leaves are then pooled and immediately transferred to liquid nitrogen containers in which the pooled leaves are crushed. The harvested tissue is then stored at −80° C. until RNA preparation.

The SATMON007 cDNA library is generated from the primary root tissue of 5 day old maize (DK604, Dekalb Genetics, Dekalb, Ill. U.S.A.) seedlings. Seeds are planted on a moist filter paper on a covered tray that is kept in the dark until germination (one day). After germination, the trays, along with the moist paper, are moved to a greenhouse where the maize plants are grown in the greenhouse in 15 hr day/9 hr night cycles for approximately 5 days. The daytime temperature is approximately 80° F. and the nighttime temperature is approximately 70° F. Supplemental lighting is provided by 1000 W sodium vapor lamps. The primary root tissue is collected when the seedlings are 5 days old. At this stage, the primary root (radicle) is pushed through the coleorhiza which itself is pushed through the seed coat. The primary root, which is about 2-3 cm long, is cut and immediately frozen in liquid nitrogen and then stored at −80° C. until RNA preparation.

The SATMON008 cDNA library is generated from the primary shoot (coleoptile 2-3 cm) of maize (DK604, Dekalb Genetics, Dekalb, Ill. U.S.A.) seedlings which are approximately 5 days old. Seeds are planted on a moist filter paper on a covered tray that is kept in the dark until germination (one day). Then the trays containing the seeds are moved to a greenhouse at 15 hr daytime/9 hr nighttime cycles and grown until they are 5 days post germination. The daytime temperature is approximately 80° F. and the nighttime temperature is approximately 70° F. Tissue is collected when the seedlings are 5 days old. At this stage, the primary shoot (coleoptile) is pushed through the seed coat and is about 2-3 cm long. The coleoptile is dissected away from the rest of the seedling, immediately frozen in liquid nitrogen and then stored at −80° C. until RNA preparation.

The SATMON009 cDNA library is generated from maize (DK604, Dekalb Genetics, Dekalb, Ill. U.S.A.) leaves at the 8 leaf stage (V8 plant development stage). Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is 80° F. and the nighttime temperature is 70° F. Supplemental lighting is provided by 1000 W sodium vapor lamps. Tissue is collected when the maize plant is at the 8-leaf development stage. The older more juvenile leaves, which are in a basal position, as well as the younger more adult leaves, which are more apical, are cut at the base of the leaves. The leaves are then pooled and then immediately transferred to liquid nitrogen containers in which the pooled leaves are crushed. The harvested tissue is then stored at −80° C. until RNA preparation.

The SATMON010 cDNA library is generated from maize (DK604, Dekalb Genetics, Dekalb, Ill. U.S.A.) root tissue at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is 80° F. and the nighttime temperature is 70° F. Supplemental lighting is provided by 1000 W sodium vapor lamps. Tissue is collected when the maize plant is at the V8 development stage. The root system is cut from this mature maize plant and washed with water to free it from the soil. The tissue is immediately frozen in liquid nitrogen. The harvested tissue is then stored at −80° C. until RNA preparation.

The SATMON011 cDNA library is generated from undeveloped maize (DK604, Dekalb Genetics, Dekalb, Ill. U.S.A.) leaf at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 6-leaf development stage. The second youngest leaf which is at the base of the apical leaf of V6 stage maize plant is cut at the base and immediately transferred to liquid nitrogen containers in which the leaf is crushed. The harvested tissue is then stored at −80° C. until RNA preparation.

The SATMON012 cDNA library is generated from 2 day post germination maize (DK604, Dekalb Genetics, Dekalb, Ill. U.S.A.) seedlings. Seeds are planted on a moist filter paper on a covered tray that is kept in the dark until germination (one day). Then the trays containing the seeds are moved to the greenhouse and grown at 15 hr daytime/9 hr nighttime cycles until 2 days post germination. The daytime temperature is approximately 80° F. and the nighttime temperature is approximately 70° F. Tissue is collected when the seedlings are 2 days old. At the two day stage, the coleorhiza is pushed through the seed coat and the primary root (the radicle) is pierced the coleorhiza but is barely visible. Also, at this two day stage, the coleoptile is just emerging from the seed coat. The 2 days post germination seedlings are then immersed in liquid nitrogen and crushed. The harvested tissue is stored at −80° C. until preparation of total RNA.

The SATMON013 cDNA library is generated from apical maize (DK604, Dekalb Genetics, Dekalb, Ill. U.S.A.) meristem founder at the V4 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Prior to tissue collection, the plant is at the 4 leaf stage. The lead at the apex of the V4 stage maize plant is referred to as the meristem founder. This apical meristem founder is cut, immediately frozen in liquid nitrogen and crushed. The harvested tissue is then stored at −80° C. until RNA preparation.

The SATMON014 cDNA library is generated from maize (DK604, Dekalb Genetics, Dekalb, Ill. U.S.A.) endosperm fourteen days after pollination. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. After the V10 stage, the maize plant ear shoots are ready for fertilization. At this stage, the ear shoots are enclosed in a paper bag before silk emergence to withhold the pollen. The ear shoots are pollinated and 14 days after pollination, the ears are pulled out and then the kernels are plucked out of the ears. Each kernel is then dissected into the embryo and the endosperm and the aleurone layer is removed. After dissection, the endosperms are immediately frozen in liquid nitrogen and then stored at −80° C. until RNA preparation.

The SATMON016 library is a maize (DK604, Dekalb Genetics, Dekalb, Ill. U.S.A.) sheath library collected at the V8 developmental stage. Seeds are planted in a depth of approximately 3 cm in solid into 2-3 inch pots containing Metro growing medium. After 2-3 weeks growth, they are transplanted into 10" pots containing the same. Plants are watered daily before transplantation and approximately the times a week after transplantation. Peters 15-16-17 fertilizer is applied approximately three times per week after transplanting, at a strength of 150 ppm N. Two to three times during the life time of the plant from transplanting to flowering, a total of approximately 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 w sodium vapor lamps. When the maize plants are at the V8 stage the $5^{th}$ and $6^{th}$ leaves from the bottom exhibit fully developed leaf blades. At the base of these leaves, the ligule is differentiated and the leaf blade is joined to the sheath. The sheath is dissected away from the base of the leaf then the sheath is frozen in liquid nitrogen and crushed. The tissue is then stored at −80° C. until RNA preparation.

The SATMON017 cDNA library is generated from maize (DK604, Dekalb Genetics, Dekalb, Ill. U.S.A.) embryo seventeen days after pollination. Seeds are planted at a depth of approximately 3 cm into 2-3 inch peat pots containing Metro 200 growing medium. After 2-3 weeks growth the seeds are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. After the V10 stage, the ear shoots of maize plant, which are ready for fertilization, are enclosed in a paper bag before silk emergence to withhold the pollen. The ear shoots are fertilized and 21 days after pollination, the ears are pulled out and the kernels are plucked out of the ears. Each kernel is then dissected into the embryo and the endosperm and the aleurone layer is removed. After dissection, the embryos are immediately frozen in liquid nitrogen and then stored at −80° C. until RNA preparation.

The SATMON019 (Lib3054) cDNA library is generated from maize (DK604, Dekalb Genetics, Dekalb, Ill. U.S.A.) culm (stem) at the V8 developmental stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. When the maize plant is at the V8 stage, the 5th and 6th leaves from the bottom have fully developed leaf blades. The region between the nodes of the 5th and the sixth leaves from the bottom is the region of the stem that is collected. The leaves are pulled out and the sheath is also torn away from the stem. This stem tissue is completely free of any leaf and sheath tissue. The stem tissue is then frozen in liquid nitrogen and stored at −80° C. until RNA preparation.

The SATMON020 cDNA library is from a maize (DK604, Dekalb Genetics, Dekalb, Ill. U.S.A.) Hill Type II-Initiated Callus. Petri plates containing approximately 25 ml of Type II initiation media are prepared. This medium contains N6 salts and vitamins, 3% sucrose, 2.3 g/liter proline 0.1 g/liter enzymatic casein hydrolysate, 2 mg/liter 2,4-dichloro phenoxyacetic acid (2,4, D), 15.3 mg/liter $AgNO_3$ and 0.8% bacto agar and is adjusted to pH 6.0 before autoclaving. At 9-11 days after pollination, an ear with immature embryos measuring approximately 1-2 mm in length is chosen. The husks and silks are removed and then the ear is broken into halves and placed in an autoclaved solution of Clorox/TWEEN 20 sterilizing solution. Then the ear is rinsed with deionized water. Then each embryo is extracted from the kernel. Intact embryos are placed in contact with the medium, scutellar side up). Multiple embryos are plated on each plate and the plates are incubated in the dark at 25° C. Type II calluses are friable, can be subcultured with a spatula, frequently regenerate via somatic embryogenesis and are relatively undifferentiated. As seen in the microscope, the Tape II calluses show color ranging from translucent to light yellow and heterogeneity on with respect to embryoid structure as well as stage of embryoid development. Once Type II callus are formed, the calluses is transferred to type II callus maintenance medium without $AgNO_3$. Every 7-10 days, the callus is subcultured. About 4 weeks after embryo isolation the callus is removed from the plates and then frozen in liquid nitrogen. The harvested tissue is stored at −80° C. until RNA preparation.

The SATMON021 cDNA library is generated from the immature maize (DK604, Dekalb Genetics, Dekalb Ill., U.S.A.) tassel at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. As the maize plant enters the V8 stage, tassels which are 15-20 cm in length are collected and frozen in liquid nitrogen. The harvested tissue is stored at −80° C. until RNA preparation.

The SATMON022 cDNA library is generated from maize (DK604, Dekalb Genetics, Dekalb, Ill. U.S.A.) ear (growing silks) at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Zea mays plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the plant is in the V8 stage. At this stage, some immature ear shoots are visible. The immature ear shoots (approximately 1 cm in length) are pulled out, frozen in liquid nitrogen and then stored at −80° C. until RNA preparation.

The SATMON23 cDNA library is generated from maize (DK604, Dekalb Genetics, Dekalb, Ill. U.S.A.) ear (growing silk) at the V8 development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. When the tissue is harvested at the V8 stage, the length of the ear that is harvested is about 10-15 cm and the silks are just exposed (approximately 1 inch). The ear along with the silks is frozen in liquid nitrogen and then the tissue is stored at −80° C. until RNA preparation.

The SATMON024 cDNA library is generated from the immature maize (DK604, Dekalb Genetics, Dekalb, Ill. U.S.A.) tassel at the V9 development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. As a maize plant enters the V9 stage, the tassel is rapidly developing and a 37 cm tassel along with the glume, anthers and pollen is collected and frozen in liquid nitrogen. The harvested tissue is stored at −80° C. until RNA preparation.

The SATMON025 cDNA library is from maize (DK604, Dekalb Genetics, Dekalb, Ill. U.S.A.) Hill Type II-Regenerated Callus. Type II callus is grown in initiation media as described for SATMON020 and then the embryoids on the surface of the Type II callus are allowed to mature and germinate. The 1-2 gm fresh weight of the soft friable type callus containing numerous embryoids are transferred to 100×15 mm petri plates containing 25 ml of regeneration media. Regeneration media consists of Murashige and Skoog (MS) basal salts, modified White's vitamins (0.2 g/liter glycine and 0.5 g/liter myo-inositol and 0.8% bacto agar (6SMS0D)). The plates are then placed in the dark after covering with parafilm. After 1 week, the plates are moved to a lighted growth chamber with 16 hr light and 8 hr dark photoperiod. Three weeks after plating the Type II callus to 6SMS0D, the callus exhibit shoot formation. The callus and the shoots are transferred to fresh 6SMS0D plates for another 2 weeks. The callus and the shoots are then transferred to petri plates with reduced sucrose (3SMS0D). Upon distinct formation of a root and shoot, the newly developed green plants are then removed out with a spatula and frozen in liquid nitrogen containers. The harvested tissue is then stored at −80° C. until RNA preparation.

The SATMON026 cDNA library is generated from maize (DK604, Dekalb Genetics, Dekalb, Ill. U.S.A.) juvenile/adult shift leaves at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plants are at the 8-leaf development stage. Leaves are founded sequentially around the meristem over weeks of time and the older, more juvenile leaves arise earlier and in a more basal position than the younger, more adult leaves, which are in a more apical position. In a V8 plant, some leaves which are in the middle portion of the plant exhibit characteristics of both juvenile as well as adult leaves. They exhibit a yellowing color but also exhibit, in part, a green color. These leaves are termed juvenile/adult shift leaves. The juvenile/adult shift leaves (the 4th, 5th leaves from the bottom) are cut at the base, pooled and transferred to liquid nitrogen in which they are then crushed. The harvested tissue is then stored at −80° C. until RNA preparation.

The SATMON027 cDNA library is generated from 6 day maize (DK604, Dekalb Genetics, Dekalb, Ill. U.S.A.) leaves. Seeds are planted at a depth of approximately 3 cm into 2-3 inch peat pots containing Metro 200 growing medium. After 2-3 weeks growth they are transplanted into 10 inch pots containing the Metro 200 growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. *Zea mays* plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Prior to tissue collection, when the plant is at the 8-leaf stage, water is held back for six days. The older, more juvenile leaves, which are in a basal position, as well as the younger, more adult leaves, which are more apical, are all cut at the base of the leaves. All the leaves exhibit significant wilting. The leaves are then pooled and immediately transferred to liquid nitrogen containers in which the pooled leaves are then crushed. The harvested tissue is then stored at −80° C. until RNA preparation.

The SATMON028 cDNA library is generated from maize (DK604, Dekalb Genetics, Dekalb, Ill. U.S.A.) roots at the V8 developmental stage that are subject to six days water stress. Seeds are planted at a depth of approximately 3 cm into 2-3 inch peat pots containing Metro 200 growing medium. After 2-3 weeks growth they are transplanted into 10 inch pots containing the Metro 200 growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Prior to tissue collection, when the plant is at the 8-leaf stage, water is held back for six days. The root system is cut, shaken and washed to remove soil. Root tissue is then pooled and immediately transferred to liquid nitrogen containers in which the pooled leaves are then crushed. The harvested tissue is then stored at −80° C. until RNA preparation.

The SATMON029 cDNA library is generated from maize (DK604, Dekalb Genetics, Dekalb, Ill. U.S.A.) seedlings at the etiolated stage. Seeds are planted on a moist filter paper on a covered tray that is kept in the dark for 4 days at approximately 70° F. Tissue is collected when the seedlings are 4 days old. By 4 days, the primary root has penetrated the coleorhiza and is about 4-5 cm and the secondary lateral roots have also made their appearance. The coleoptile has also pushed through the seed coat and is about 4-5 cm long. The seedlings are frozen in liquid nitrogen and crushed. The harvested tissue is then stored at −80° C. until RNA preparation.

The SATMON030 cDNA library is generated from maize (DK604, Dekalb Genetics, Dekalb, Ill. U.S.A.) root tissue at the V4 plant development stage. Seeds are planted at a depth of approximately 3 cm into 2-3 inch peat pots containing Metro 200 growing medium. After 2-3 weeks growth, they are transplanted into 10 inch pots containing the same. Plants are watered daily before transplantation and approximately 3 times a week after transplantation. Peters 15-16-17 fertilizer is applied approximately three times per week after transplanting, at a strength of 150 ppm N. Two to three times during the life time of the plant, from transplanting to flowering, a total of approximately 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 sodium vapor lamps. Tissue is collected when the maize plant is at the 4 leaf development stage. The root system is cut from the mature maize plant and washed with water to free it from the soil. The tissue is then immediately frozen in liquid nitrogen. The harvested tissue is then stored at −80° C. until RNA preparation.

The SATMON031 cDNA library is generated from the maize (DK604, Dekalb Genetics, Dekalb, Ill. U.S.A.) leaf tissue at the V4 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is 80° F. and the nighttime temperature is 70° F. Supplemental lighting is provided by 1000 W sodium vapor lamps. Tissue is collected when the maize plant is at the 4-leaf development stage. The third leaf from the bottom is cut at the base and immediately frozen in liquid nitrogen and crushed. The tissue is immediately frozen in liquid nitrogen. The harvested tissue is then stored at −80° C. until RNA preparation.

The SATMON033 cDNA library is generated from maize (DK604, Dekalb Genetics, Dekalb, Ill. U.S.A.) embryo tissue 13 days after pollination. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. After the V10 stage, the ear shoots of the maize plant, which are ready for fertilization, are enclosed in a paper bag before silk emergent to withhold the pollen. The ear shoots are pollinated and 13 days after pollination, the ears are pulled out and then the kernels are plucked cut of the ears. Each kernel is then dissected into the embryo and the endosperm and the aleurone layer is removed. After dissection, the embryos are immediately frozen in liquid nitrogen and then stored at −80° C. until RNA preparation.

The SATMON034 cDNA library is generated from cold stressed maize (DK604, Dekalb Genetics, Dekalb, Ill. U.S.A.) seedlings. Seeds are planted on a moist filter paper on a covered tray that is kept on at 10° C. for 7 days. After 7 days, the temperature is shifted to 15° C. for one day until germination of the seed. Tissue is collected once the seedlings are 1 day old. At this point, the coleorhiza has just pushed out of the seed coat and the primary root is just making its appearance. The coleoptile has not yet pushed completely through the seed coat and is also just making its appearance. These 1 day old cold stressed seedlings are frozen in liquid nitrogen and crushed. The harvested tissue is then stored at −80° C. until RNA preparation.

The SATMON~001 (Lib36, Lib83, Lib84) cDNA library is generated from maize leaves at the V8 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the nighttime temperature is approximately 70° F. Supplemental lighting is provided by 1000 W sodium vapor lamps. Tissue from the maize plant is collected at the V8 stage. The older more juvenile leaves in a basal position was well as the younger more adult leaves which are more apical are all cut at the base, pooled and frozen in liquid nitrogen. The harvested tissue is then stored at −80° C. until RNA preparation.

The SATMONN01 cDNA library is generated from maize (B73, Illinois Foundation Seeds, Champaign, Illinois, U.S.A.) normalized immature tassels at the V6 plant development stage normalized tissue. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in a greenhouse in 15 hr day/9 hr night cycles. The daytime temperature is approximately 80° F. and the night time temperature is approximately 70° F. Supplemental lighting is provided by 1000 W sodium vapor lamps. Tissue from the maize plant is collected at the V6 stage. At that stage the tassel is an immature tassel of about 2-3 cm in length. The tassels are removed and frozen in liquid nitrogen. The harvested tissue is then stored at −80° C. until RNA preparation. Single stranded and double stranded DNA representing approximately $1\times10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on DYNABEADS M280 streptavidin (DYNABEADS, Dynal Corporation, Lake Success, N.Y., U.S.A.). The dynabeads with captured hybrids are collected with a magnet. The non-hybridized single stranded molecules remaining after hybrid capture are converted to double stranded form and represent the primary normalized library.

The SATMONN04 cDNA library is generated from maize (B73 x Mo 17, Illinois Foundation Seeds, Champaign, Illinois, U.S.A.) normalized total leaf tissue at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately SOT and the night time temperature is approximately 70° F. Supplemental lighting is provided by 1000 W sodium vapor lamps. Tissue is collected when the maize plant is at the 6-leaf development stage. The older, more juvenile leaves, which are in a basal position, as well as the younger, more adult leaves, which are more apical are cut at the base of the leaves. The leaves are then pooled and immediately transferred to liquid nitrogen containers in which the pooled leaves are crushed. The harvested tissue is then stored at −80° C. until RNA preparation. Single stranded and double stranded DNA representing approximately $1\times10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on DYNABEADS M280 streptavidin (DYNABEADS, Dynal Corporation, Lake Success, N.Y., U.S.A.). The dynabeads with captured hybrids are collected with a magnet. The non-hybridized single stranded molecules remaining after hybrid capture are converted to double stranded form and represent the primary normalized library.

The SATMONN05 cDNA library is generated from maize (B73 x Mo 17, Illinois Foundation Seeds, Champaign, Illinois, U.S.A.) normalized root tissue at the V6 development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant. from transplanting to flowering, a total of 900 mg Fe is added to each pot. Maize plants are grown in the green house in 15 hr day/9 hr night cycles. The daytime temperature is approximately 80° F. and the night time temperature is approximately 70° F. Supplemental lighting is provided by 1000 W sodium vapor lamps. Tissue is collected when the maize plant is at the 6-leaf development stage. The root system is cut from the mature maize plant and washed with water to free it from the soil. The tissue is immediately frozen in liquid nitrogen and the harvested tissue is then stored at −80° C. until RNA preparation. The single stranded and double stranded DNA representing approximately $1\times10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on DYNABEADS M280 streptavidin (DYNABEADS, Dynal Corporation, Lake Success, N.Y., U.S.A.). The dynabeads with captured hybrids are collected with a magnet. The non-hybridized single stranded molecules remaining after hybrid capture are converted to double stranded form and represent the primary normalized library.

The SATMONN06 cDNA library is generated from maize (B73 x Mo17, illinois Foundation Seeds, Champaign Illinois, U.S.A.) normalized total leaf tissue at the V6 plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the night time temperature is approximately 70° F. Supplemental lighting is provided by 1000 W sodium vapor lamps. Tissue is collected when the maize plant is at the 6-leaf development stage. The older more juvenile leaves, which are in a basal position, as well as the younger more adult leaves, which are more apical are cut at the base of the leaves. The leaves are then pooled and immediately transferred to liquid nitrogen containers in which the pooled leaves are crushed. The harvested tissue is then stored at −80° C. until RNA preparation. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on DYNABEADS M280 streptavidin (DYNA13EADS, Dynal Corporation, Lake Success, N.Y., U.S.A.). The dynabeads with captured hybrids are collected with a magnet. The non-hybridized single stranded molecules remaining after hybrid capture are converted to double stranded form and represent the primary normalized library.

The CMZ029 (SATMON036) cDNA library is generated from maize (DK604, Dekalb Genetics, Dekalb, Ill. U.S.A.) endosperm 22 days after pollination. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the green house in 15 hr day/9 hr night cycles. The daytime temperature is approximately 80° F. and the nighttime temperature is approximately 70° F. Supplemental lighting is provided by 1000 W sodium vapor lamps. After the V10 stage, the ear shoots of the maize plant, which are ready for fertilization, are enclosed in a paper bag before silk emergent to withhold the pollen. The ear shoots are pollinated and 22 days after pollination, the ears are pulled out and then the kernels are plucked out of the ears. Each kernel is then dissected into the embryo and the endosperm and the alurone layer is removed. After dissection, the endosperms are immediately frozen in liquid nitrogen and then stored at −80° C. until RNA preparation.

The CMz030 (Lib143) cDNA library is generated from maize seedling tissue two days post germination. Seeds are planted on a moist filter paper on a covered try that is keep in the dark until germination. The trays are then moved to the bench top at 15 hr daytime/9 hr nighttime cycles for 2 days post-germination. The day time temperature is 80° F. and the nighttime temperature is 70° F. Tissue is collected when the seedlings are 2 days old. At this stage, the colehrhiza has pushed through the seed coat and the primary root (the radicle) is just piercing the colehrhiza and is barely visible. The seedlings are placed at 42° C. for 1 hour. Following the heat shock treatment, the seedlings are immersed in liquid nitrogen and crushed. The harvested tissue is stored at −80° until RNA preparation.

The CMz031 (Lib 148) cDNA library is generated from maize pollen tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants. The ear shoots, which are ready for fertilization, are enclosed in a paper bag to withhold pollen. Twenty-one days after pollination, prior to removing the ears, the paper bag is shaken to collect the mature pollen. The mature pollen is immediately frozen in liquid nitrogen containers and the pollen is crushed. The harvested tissue is then stored at −80° C. until RNA preparation.

The CMz033 (Lib189) cDNA library is generated from maize pooled leaf tissue. Samples are harvested from open pollinated plants. Tissue is collected from maize leaves at the anthesis stage. The leaves are collect from 10-12 plants and frozen in liquid nitrogen. The harvested tissue is then stored at −80° C. until RNA preparation.

The CMz034 (Lib3060) cDNA library is generated from maize mature tissue at 40 days post pollination plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from leaves located two leaves below the ear leaf. This sample represents those genes expressed during onset and early stages of leaf senescence. The leaves are pooled and immediately transferred to liquid nitrogen. The harvested tissue is then stored at −80° C. until RNA preparation.

The CMz036 (Lib3062) cDNA library is generated from maize husk tissue at the 8 week old plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from 8 week old plants. The husk is separated from the ear and immediately transferred to liquid nitrogen containers. The harvested tissue is then stored at −80° C. until RNA preparation.

The CMz037 (Lib3059) cDNA library is generated from maize pooled kernal at 12-15 days after polliention plant development stage. Sample were collected from field grown material. Whole kernals from hand pollinated (control pollination) are harvested as whole ears and immediately frozen on dry ice. Kernels from 10-12 ears were pooled and ground together in liquid nitrogen. The harvested tissue is then stored at −80° C. until RNA preparation.

The CMz039 (Lib3066) cDNA library is generated from maize immature anther tissue at the 7 week old immature tassel stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 7 week old immature tassel stage. At this stage, prior to anthesis, the immature anthers are green and enclosed in the staminate spikelet. The developing anthers are dissected away from the 7 week old immature tassel and immediately frozen in liquid nitrogen. The harvested tissue is then stored at −80° C. until RNA preparation.

The CMz040 (Lib3067) cDNA library is generated from maize kernel tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants. The ear shoots, which are ready for fertilization, are enclosed in a paper bag before silk emergence to withhold pollen. Five to eight days after controlled pollination. The ears are pulled and the kernels removed. The kernels are immediately frozen in liquid nitrogen. The harvested kernels tissue is then stored at −80° C. until RNA preparation. This sample represents gene expressed in early kernel development, during periods of cell division, amyloplast biogenesis and early carbon flow across the material to filial tissue.

The CMz041 (Lib3068) cDNA library is generated from maize pollen germinating silk tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants when the ear shoots are ready for fertilization at the silk emergence stage. The emerging silks are pollinated with an excess of pollen under controlled pollination conditions in the green house. Eighteen hours after pollination the silks are removed from the ears and immediately frozen in liquid nitrogen containers. This sample represents genes expressed in both pollen and silk tissue early in pollination. The harvested tissue is then stored at −80° C. until RNA preparation.

The CMz042 (Lib3069) cDNA library is generated from maize ear tissue excessively pollinated at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ stage plants and the ear shoots which are ready for fertilization are at the silk emergence stage. The immature ears are pollinated with an excess of pollen under controlled pollination conditions. Eighteen hours post-pollination, the ears are removed and immediately transferred to liquid nitrogen containers. The harvested tissue is then stored at −80° C. until RNA preparation.

The CMz044 (Lib3075) cDNA library is generated from maize microspore tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from immature anthers from 7 week old tassels. The immature anthers are first dissected from the 7 week old tassel with a scalpel on a glass slide covered with water. The microspores (immature pollen) are released into the water and are recovered by centrifugation. The microspore suspension is immediately frozen in liquid nitrogen. The harvested tissue is then stored at −80° C. until RNA preparation.

The CMz045 (Lib3076) cDNA library is generated from maize immature ear megaspore tissue. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from immature ear (megaspore) obtained from 7 week old plants. The immature ears are harvested from the 7 week old plants and are approximately 2.5 to 3 cm in length. The kernels are removed from the cob immediately frozen in liquid nitrogen. The harvested tissue is then stored at −80° C. until RNA preparation.

The CMz047 (Lib3078) cDNA library is generated from maize $CO_2$ treated high-exposure shoot tissue at the V10+ plant development stage. RX601 maize seeds are sterilized for i minute with a 10% clorox solution. The seeds are rolled in germination paper, and germinated in 0.5 mM calcium sulfate solution for two days ate 30° C. The seedlings are planted at a depth of approximately 3 cm into 2-3 inch peat pots containing Metro 200 growing medium at a rate of 2-3 seedlings per pot. Twenty pots are placed into a high $CO_2$ environment (approximately 1000 ppm $CO_2$). Twenty plants were grown under ambient greenhouse $CO_2$ (approximately 450 ppm $CO_2$). Plants are watered daily before transplantation and three times a week after transplantation. Peters 20-20-20 fertilizer is also lightly applied. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. At ten days post planting, the shoots from both atmosphere are frozen in liquid nitrogen and lightly ground. The roots are washed in deionized water to remove the support media and the tissue is immediately transferred to liquid nitrogen containers. The harvested tissue is then stored at −80° C. until RNA preparation.

The CMz048 (Lib3079) cDNA library is generated from maize basal endosperm transfer layer tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected from V10+ maize plants. The ear shoots, which are ready for fertilization, are enclosed in a paper bag prior to silk emergence, to withhold the pollen. Kernels are harvested at 12 days post-pollination and placed on wet ice for dissection. The kernels are cross sectioned laterally, dissecting just above the pedicel region, including 1-2 mm of the lower endosperm and the basal endosperm transfer region. The pedicel and lower endosperm region containing the basal endosperm transfer layer is pooled and immediately frozen in liquid nitrogen. The harvested tissue is then stored at −80° C. until RNA preparation.

The CMz049 (Lib3088) cDNA library is generated from maize immature anther tissue at the 7 week old immature tassel stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is at the 7 week old immature tassel stage. At this stage, prior to anthesis, the immature anthers are green and enclosed in the staminate spikelet. The developing anthers are dissected away from the 7 week old immature tassel and immediately transferred to liquid nitrogen container. The harvested tissue is then stored at −80° C. until RNA preparation.

The CMz050 (Lib3114) cDNA library is generated from maize silk tissue at the V10+ plant development stage. Seeds are planted at a depth of approximately 3 cm into 2-3 inch peat pots containing Metro 200 growing medium. After 2-3 weeks growth they are transplanted into 10 inch pots containing the same growing medium. Plants are watered daily before transplantation and three times a week after transplantation. Peters 15-16-17 fertilizer is applied three times per week after transplanting at a strength of 150 ppm N. Two to three times during the lifetime of the plant, from transplanting to flowering, a total of 900 mg Fe is added to each pot. Maize plants are grown in the greenhouse in 15 hr day/9 hr night cycles. The daytime temperature is approximately 80° F. and the nighttime temperature is approximately 70° F. Supplemental lighting is provided by 1000 W sodium vapor lamps. Tissue is collected when the maize plant is beyond the 10-leaf development stage and the ear shoots are approximately 15-20 cm in length. The ears are pulled and silks are separated from the ears and immediately transferred to liquid nitrogen containers. The harvested tissue is then stored at −80° C. until RNA preparation.

The SOYMON001 cDNA library is generated from soybean cultivar Asgrow 3244 (Asgrow Seed Company, Des Moines, Iowa U.S.A.) total leaf tissue at the V4 plant development stage. Leaf tissue from 38, field grown V4 stage plants is harvested from the $4^{th}$ node. Leaf tissue is removed from the plants and immediately frozen in dry-ice. The harvested tissue is then stored at −80° C. until RNA preparation.

The SOYMON002 cDNA library is generated from soybean cultivar Asgrow 3244 (Asgrow Seed Company, Des Moines, Iowa U.S.A.) root tissue at the V4 plant development stage. Root tissue from 76, field grown V4 stage plants is harvested. The root systems is cut from the soybean plant and washed with water to free it from the soil and immediately frozen in dry-ice. The harvested tissue is then stored at −80° C. until RNA preparation.

The SOYMON003 cDNA library is generated from soybean cultivar Asgrow 3244 (Asgrow Seed Company, Des Moines, Iowa U.S.A.) seedling hypocotyl axis tissue harvested 2 day post-imbibition. Seeds are planted at a depth of approximately 2 cm into 2-3 inch peat pots containing Metromix 350 medium. Trays are placed in an environmental chamber and grown at 12 hr daytime/12 hr nighttime cycles. The daytime temperature is approximately 29° C. and the nighttime temperature approximately 24° C. Soil is checked and watered daily to maintain even moisture conditions. Tissue is collected 2 days after the start of imbibition. The 2 days after imbibition samples are separated into 3 collections after removal of any adhering seed coat. At the 2 day stage, the hypocotyl axis is emerging from the soil. A few seedlings have cracked the soil surface and exhibited slight greening of the exposed cotyledons. The seedlings are washed in water to remove soil, hypocotyl axis harvested and immediately frozen in liquid nitrogen. The harvested tissue is then stored at −80° C. until RNA preparation.

The SOYMON004 cDNA library is generated from soybean cultivar Asgrow 3244 (Asgrow Seed Company, Des Moines, Iowa U.S.A.) seedling cotyledon tissue harvested 2 day post-imbibition. Seeds are planted at a depth of approximately 2 cm into 2-3 inch peat pots containing Metromix 350 medium. Trays are placed in an environmental chamber and grown at 12 hr daytime/12 hr nighttime cycles. The daytime temperature is approximately 29° C. and the nighttime temperature approximately 24° C. Soil is checked and watered daily to maintain even moisture conditions. Tissue is collected 2 days after the start of imbibition. The 2 days after imbibition samples are separated into 3 collections after removal of any adhering seed coat. At the 2 day stage, the hypocotyl axis is emerging from the soil. A few seedlings have cracked the soil surface and exhibited slight greening of the exposed cotyledons. The seedlings are washed in water to remove soil, hypocotyl axis harvested and immediately frozen in liquid nitrogen. The harvested tissue is then stored at −80° C. until RNA preparation.

The SOYMON005 cDNA library is generated from soybean cultivar Asgrow 3244 (Asgrow Seed Company, Des Moines, Iowa U.S.A.) seedling hypocotyl axis tissue harvested 6 hour post-imbibition. Seeds are planted at a depth of approximately 2 cm into 2-3 inch peat pots containing Metromix 350 medium. Trays are placed in an environmental chamber and grown at 12 hr daytime/12 hr nighttime cycles. The daytime temperature is approximately 29° C. and the nighttime temperature approximately 24° C. Soil is checked and watered daily to maintain even moisture conditions. Tissue is collected 6 hours after the start of imbibition. The 6 hours after imbibition samples are separated into 3 collections after removal of any adhering seed coat. The 6 hours after imbibition sample is collected over the course of approximately 2 hours starting at 6 hours post imbibition. At the 6 hours after imbibition stage, not all cotyledons have become fully hydrated and germination, or radicle protrusion, has not occurred. The seedlings are washed in water to remove soil, hypocotyl axis harvested and immediately frozen in liquid nitrogen. The harvested tissue is then stored at −80° C. until RNA preparation.

The SOYMON006 cDNA library is generated from soybean cultivar Asgrow 3244 (Asgrow Seed Company, Des Moines, Iowa U.S.A.) seedling cotyledons tissue harvest 6 hour post-imbibition. Seeds are planted at a depth of approximately 2 cm into 2-3 inch peat pots containing Metromix 350 medium. Trays are placed in an environmental chamber and grown at 12 hr daytime/12 hr nighttime cycles. The daytime temperature is approximately 29° C. and the nighttime temperature approximately 24° C. Soil is checked and watered daily to maintain even moisture conditions. Tissue is collected 6 hours after imbibition. The 6 hours after imbibition samples are separated into 3 collections after removal of any adhering seed coat. The 6 hours after imbibition sample is collected over the course of approximately 2 hours starting at 6 hours post-imbibition. At the 6 hours after imbibition, not all cotyledons have become fully hydrated and germination or radicle protrusion, have not occurred. The seedlings are washed in water to remove soil, cotyledon harvested and immediately frozen in liquid nitrogen. The harvested tissue is then stored at −80° C. until RNA preparation.

The SOYMON007 cDNA library is generated from soybean cultivar Asgrow 3244 (Asgrow Seed Company, Des Moines, Iowa U.S.A.) seed tissue harvested 25 and 35 days post-flowering. Seed pods from field grown plants are harvested 25 and 35 days after flowering and the seeds extracted from the pods. Approximately 4.4 g and 19.3 g of seeds are harvested from the respective seed pods and immediately frozen in dry ice. The harvested tissue is then stored at −80° C. until RNA preparation.

The SOYMON008 cDNA library is generated from soybean cultivar Asgrow 3244 (Asgrow Seed Company, Des Moines, Iowa U.S.A.) leaf tissue harvested from 25 and 35 days post-flowering plants. Total leaf tissue is harvested from field grown plants. Approximately 19 g and 29 g of leaves are harvested from the fourth node of the plant 25 and 35 days post-flowering and immediately frozen in dry ice. The harvested tissue is then stored at −80° C. until RNA preparation.

The SOYMON009 cDNA library is generated from soybean cutlivar C1944 (USDA Soybean Germplasm Collection, Urbana, Ill. U.S.A.) pod and seed tissue harvested 15 days post-flowering. Pods from field grown plants are harvested 15 days post-flowering. Approximately 3 g of pod tissue is harvested and immediately frozen in dry-ice. The harvested tissue is then stored at −80° C. until RNA preparation.

The SOYMON010 cDNA library is generated from soybean cultivar C1944 (USDA Soybean Germplasm Collection, Urbana, Ill. U.S.A.) seed tissue harvested 40 days post-flowering. Pods from field grown plants are harvested 40 days post-flowering. Pods and seeds are separated, approximately 19 g of seed tissue is harvested and immediately frozen in dry-ice. The harvested tissue is then stored at −80° C. until RNA preparation.

The SOYMON011 cDNA library is generated from soybean cultivars Cristalina (USDA Soybean Germplasm Collection, Urbana, Ill. U.S.A.) and FT108 (Monsoy, Brazil) (tropical germ plasma) leaf tissue. Leaves are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 30 g of leaves are harvested from the 4' node of each of the Cristalina and FT108 cultivars and immediately frozen in dry ice. The harvested tissue is then stored at −80° C. until RNA preparation.

The SOYMON012 cDNA library is generated from soybean cultivar Asgrow 3244 (Asgrow Seed Company, Des Moines, Iowa U.S.A.) leaf tissue. Leaves from field grown plants are harvested from the fourth node 15 days post-flowering. Approximately 12 g of leaves are harvested and immediately frozen in dry ice. The harvested tissue is then stored at −80° C. until RNA preparation.

The SOYMON013 cDNA library is generated from soybean cultivar Asgrow 3244 (Asgrow Seed Company, Des Moines, Iowa U.S.A.) root and nodule tissue. Approximately, 28 g of root tissue from field grown plants is harvested 15 days post-flowering. The root system is cut from the soybean plant, washed with water to free it from the soil and immediately frozen in dry-ice. The harvested tissue is then stored at −80° C. until RNA preparation.

The SOYMON014 cDNA library is generated from soybean cultivar Asgrow 3244 (Asgrow Seed Company, Des Moines, Iowa U.S.A.) seed tissue harvested 25 and 35 days after flowering. Seed pods from field grown plants are harvested 15 days after flowering and the seeds extracted from the pods. Approximately 5 g of seeds are harvested from the respective seed pods and immediately frozen in dry ice. The harvested tissue is then stored at −80° C. until RNA preparation.

The SOYMON015 cDNA is generated from soybean cultivar Asgrow 3244 (Asgrow Seed Company, Des Moines, Iowa U.S.A.) seed tissue harvested 45 and 55 days post-flowering. Seed pods from field grown plants are harvested 45 and 55 days after flowering and the seeds extracted from the pods. Approximately 19 g and 31 g of seeds are harvested from the respective seed pods and immediately frozen in dry ice. The harvested tissue is then stored at −80° C. until RNA preparation.

The SOYMON016 cDNA library is generated from soybean cultivar Asgrow 3244 (Asgrow Seed Company, Des Moines, Iowa U.S.A.) root tissue. Approximately, 61 g and 38 g of root tissue from field grown plants is harvested 25 and 35 days post-flowering is harvested. The root system is cut from the soybean plant and washed with water to free it from the soil. The tissue is placed in 14 ml polystyrene tubes and immediately frozen in dry-ice. The harvested tissue is then stored at −80° C. until RNA preparation.

The SOYMON017 cDNA library is generated from soybean cultivar Asgrow 3244 (Asgrow Seed Company, Des Moines, Iowa U.S.A.) root tissue. Approximately 28 g of root tissue from field grown plants is harvested 45 and 55 days post-flowering. The root system is cut from the soybean plant, washed with water to free it from the soil and immediately frozen in dry-ice. The harvested tissue is then stored at −80° C. until RNA preparation.

The SOYMON018 cDNA is generated from soybean cultivar Asgrow 3244 (Asgrow Seed Company, Des Moines, Iowa U.S.A.) leaf tissue harvested 45 and 55 days post-flowering. Leaves from field grown plants are harvested 45 and 55 days after flowering from the fourth node. Approximately 27 g and 33 g of seeds are harvested from the respective seed pods and immediately frozen in dry ice. The harvested tissue is then stored at −80° C. until RNA preparation.

The SOYMON019 cDNA library is generated from soybean cultivars Cristalina (USDA Soybean Germplasm Collection, Urbana, Ill. U.S.A.) and FT108 (Monsoy, Brazil) (tropical germ plasma) root tissue. Roots are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 50 g and 56 g of roots are harvested from each of the Cristalina and FT108 cultivars and immediately frozen in dry ice. The harvested tissue is then stored at −80° C. until RNA preparation.

The SOYMON020 cDNA is generated from soybean cultivar Asgrow 3244 (Asgrow Seed Company, Des Moines, Iowa U.S.A.) seed tissue harvested 65 and 75 days post-flowering. Seed pods from field grown plants are harvested 45 and 55 days after flowering and the seeds extracted from the pods. Approximately 14 g and 31 g of seeds are harvested from the respective seed pods and immediately frozen in dry ice. The harvested tissue is then stored at −80° C. until RNA preparation.

The SOYMON021 cDNA library is generated from Soybean Cyst Nematode-resistant soybean cultivar Hartwig (USDA Soybean Germplasm Collection, Urbana, Ill. U.S.A.) root tissue. Plants are grown in tissue culture at room temperature. At approximately 6 weeks post-germination, the plants are exposed to sterilized Soybean Cyst Nematode eggs. Infection is then allowed to progress for 10 days. After the 10 day infection process, the tissue is harvested. Agar from the culture medium and nematodes are removed and the root tissue is immediately frozen in dry ice. The harvested tissue is then stored at −80° C. until RNA preparation.

The SOYMON022 (Lib3030) cDNA library is generated from soybean cultivar Asgrow 3244 (Asgrow Seed Company, Des Moines, Iowa U.S.A.) partially opened flower tissue. Partially to fully opened flower tissue is harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. A total of 3 g of flower tissue is harvested and immediately frozen in dry ice. The harvested tissue is then stored at −80° C. until RNA preparation.

The SOYMON023 cDNA library is generated from soybean genotype BW211S Null (Tohoku University, Morioka, Japan) seed tissue harvested 15 and 40 days post-flowering. Seed pods from field grown plants are harvested 15 and 40 days post-flowering and the seeds extracted from the pods. Approximately 0.7 g and 14.2 g of seeds are harvested from the respective seed pods and immediately frozen in dry ice. The harvested tissue is then stored at −80° C. until RNA preparation.

The SOYMON024 cDNA library is generated from soybean cultivar Asgrow 3244 (Asgrow Seed Company, Des Moines, Iowa U.S.A.) internode-2 tissue harvested 18 days post-imbibition. Seeds are planted at a depth of approximately 2 cm into 2-3 inch peat pots containing Metromix 350 medium. The plants are grown in a greenhouse for 18 days after the start of imbibition at ambient temperature. Soil is checked and watered daily to maintain even moisture conditions. Stem tissue is harvested 18 days after the start of imbibition. The samples are divided into hypocotyl and internodes 1 through 5. The fifth internode contains some leaf bud material. Approximately 3 g of each sample is harvested and immediately frozen in dry ice. The harvested tissue is then stored at −80° C. until RNA preparation.

The SOYMON025 cDNA library is generated from soybean cultivar Asgrow 3244 (Asgrow Seed Company, Des Moines, Iowa U.S.A.) leaf tissue harvested 65 days post-flowering. Leaves are harvested from the fourth node of field grown plants 65 days post-flowering. Approximately 18.4 g of leaf tissue is harvested and immediately frozen in dry ice. The harvested tissue is then stored at −80° C. until RNA preparation.

SOYMON026 cDNA library is generated from soybean cultivar Asgrow 3244 (Asgrow Seed Company, Des Moines, Iowa U.S.A.) root tissue harvested 65 and 75 days post-flowering. Approximately 27 g and 40 g of root tissue from field grown plants is harvested 65 and 75 days post-flowering. The root system is cut from the soybean plant, washed with water to free it from the soil and immediately frozen in dry-ice. The harvested tissue is then stored at −80° C. until RNA preparation.

The SOYMON027 cDNA library is generated from soybean cultivar Asgrow 3244 (Asgrow Seed Company, Des Moines, Iowa U.S.A.) seed tissue harvested 25 days post-flowering. Seed pods from field grown plants are harvested 25 days post-flowering and the seeds extracted from the pods. Approximately 17 g of seeds are harvested from the seed pods and immediately frozen in dry ice. The harvested tissue is then stored at −80° C. until RNA preparation.

The SOYMON028 cDNA library is generated from soybean cultivar Asgrow 3244 (Asgrow Seed Company, Des Moines, Iowa U.S.A.) drought-stressed root tissue. The plants are grown in an environmental chamber under 12 hr daytime/12 hr nighttime cycles. The daytime temperature is approximately 29° C. and the nighttime temperature 24° C.

Soil is checked and watered daily to maintain even moisture conditions. At the R3 stage of development, water is withheld from half of the plant collection (drought stressed population). After 3 days, half of the plants from the drought stressed condition and half of the plants from the control population are harvested. After another 3 days (6 days post drought induction) the remaining plants are harvested. A total of 27 g and 40 g of root tissue is harvested and immediately frozen in dry ice. The harvested tissue is then stored at −80° C. until RNA preparation.

The SOYMON029 cDNA library is generated from Soybean Cyst Nematode-resistant soybean cultivar PI07354 (USDA Soybean Germplasm Collection, Urbana, Ill. U.S.A.) root tissue. Late fall to early winter greenhouse grown plants are exposed to Soybean Cyst Nematode eggs. At 10 days post-infection, the plants are uprooted, rinsed briefly and the roots frozen in liquid nitrogen. Approximately 20 grams of root tissue is harvested from the infected plants. The harvested tissue is then stored at −80° C. until RNA preparation.

The SOYMON030 cDNA library is generated from soybean cultivar Asgrow 3244 (Asgrow Seed Company, Des Moines, Iowa U.S.A.) flower bud tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature approximately 24° C. Soil is checked and watered daily to maintain even moisture conditions. Flower buds are removed from the plant at the pedicel. A total of 100 mg of flower buds are harvested and immediately frozen in liquid nitrogen. The harvested tissue is then stored at −80° C. until RNA preparation.

The SOYMON031 cDNA library is generated from soybean cultivar Asgrow 3244 (Asgrow Seed Company, Des Moines, Iowa U.S.A.) carpel and stamen tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature approximately 24° C. Soil is checked and watered daily to maintain even moisture conditions. Flower buds are removed from the plant at the pedicel. Flowers are dissected to separate petals, sepals and reproductive structures (carpels and stamens). A total of 300 mg of carpel and stamen tissue are harvested and immediately frozen in liquid nitrogen. The harvested tissue is then stored at −80° C. until RNA preparation.

The SOYMON032 cDNA library is prepared from the Asgrow cultivar A4922 (Asgrow Seed Company, Des Moines, Iowa U.S.A.) rehydrated dry soybean seed meristem tissue. Surface sterilized seeds are germinated in liquid media for 24 hours. The seed axis is then excised from the barely germinating seed, placed on tissue culture media and incubated overnight at 20° C. in the dark. The supportive tissue is removed from the explant prior to harvest. Approximately 570 mg of tissue is harvested and frozen in liquid nitrogen. The harvested tissue is then stored at −80° C. until RNA preparation.

The SOYMON033 cDNA library is generated from soybean cultivar Asgrow 3244 (Asgrow Seed Company, Des Moines, Iowa U.S.A.) heat-shocked seedling tissue without cotyledons. Seeds are imbibed and germinated in vermiculite for 2 days under constant illumination. After 48 hours, the seedlings are transferred to an incubator set at 40° C. under constant illumination. After 30, 60 and 180 minutes seedlings are harvested and dissected. A portion of the seedling consisting of the root, hypocotyl and apical hook is frozen in liquid nitrogen and stored at −80° C. The seedlings after 2 days of imbibition are beginning to emerge from the vermiculite surface. The apical hooks are dark green in appearance. Total RNA and poly A$^+$ RNA is prepared from equal amounts of pooled tissue.

The SOYMON034 cDNA library is generated from soybean cultivar Asgrow 3244 (Asgrow Seed Company, Des Moines, Iowa U.S.A.) cold-shocked seedling tissue without cotyledons. Seeds are imbibed and germinated in vermiculite for 2 days under constant illumination. After 48 hours, the seedlings are transferred to a cold room set at 5° C. under constant illumination. After 30, 60 and 180 minutes seedlings are harvested and dissected. A portion of the seedling consisting of the root, hypocotyl and apical hook is frozen in liquid nitrogen and stored at −80° C. The seedlings after 2 days of imbibition are beginning to emerge from the vermiculite surface. The apical hooks are dark green in appearance.

The SOYMON035 cDNA library is generated from soybean cultivar Asgrow 3244 (Asgrow Seed Company, Des Moines, Iowa U.S.A.) seed coat tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Seeds are harvested from mid to nearly full maturation (seed coats are not yellowing). The entire embryo proper is removed from the seed coat sample and the seed coat tissue are harvested and immediately frozen in liquid nitrogen. The harvested tissue is then stored at −80° C. until RNA preparation.

The SOYMON036 cDNA library is generated from soybean cultivars PI171451, PI227687 and PI229358 (USDA Soybean Germplasm Collection, Urbana, Ill. U.S.A.) insect challenged leaves. Plants from each of the three cultivars are grown in screenhouse conditions. The screenhouse is divided in half and one half of the screenhouse is infested with soybean looper and the other half infested with velvetbean caterpillar. A single leaf is taken from each of the representative plants at 3 different time points, 11 days after infestation, 2 weeks after infestation and 5 weeks after infestation and immediately frozen in liquid nitrogen. The harvested tissue is then stored at −80° C. until RNA preparation. Total RNA and poly A+ RNA is isolated from pooled tissue consisting of equal quantities of all 18 samples (3 genotypes×3 sample times×2 insect genotypes).

The SOYMON037 cDNA library is generated from soybean cultivar A3244 (Asgrow Seed Company, Des Moines, Iowa U.S.A.) etiolated axis and radical tissue. Seeds are planted in moist vermiculite, wrapped and kept at room temperature in complete darkness until harvest. Etiolated axis and hypocotyl tissue is harvested at 2, 3 and 4 days post-planting. A total of 1 gram of each tissue type is harvested at 2, 3 and 4 days after planting and immediately frozen in liquid nitrogen. The harvested tissue is then stored at −80° C. until RNA preparation.

The SOYMON038 cDNA library is generated from soybean variety Asgrow A3237 (Asgrow Seed Company, Des Moines, Iowa U.S.A.) rehydrated dry seeds. Explants are prepared for transformation after germination of surface-sterilized seeds on solid tissue media. After 6 days, at 28° C. and 18 hours of light per day, the germinated seeds are cold shocked at 4° C. for 24 hours. Meristemic tissue and part of the hypocotyl is remove and cotyledon excised. The prepared explant is then wounded for *Agrobacterium* infection. The 2 grams of harvested tissue is frozen in liquid nitrogen and stored at −80° C. until RNA preparation.

The Soy51 (LIB3027) cDNA library is prepared from equal amounts tissue harvested from SOYMON007, SOYMON015 and SOYMON020 prepared tissue. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on DYNABEADS M280 streptavidin (DYNABEADS, Dynal Corporation, Lake Success, N.Y., U.S.A.). The dynabeads with captured hybrids are collected with a magnet. The non-hybridized single stranded molecules remaining after hybrid capture are converted to double stranded form and represent the primary normalized library.

The Soy52 (LIB3028) cDNA library is generated from normalized flower DNA. Single stranded DNA representing approximately $1 \times 10^6$ colony forming units of SOYMON022 harvested tissue is used as the starting material for normalization. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on DYNABEADS M280 streptavidin (DYNABEADS, Dynal Corporation, Lake Success, N.Y., U.S.A.). The dynabeads with captured hybrids are collected with a magnet. The non-hybridized single stranded molecules remaining after hybrid capture are converted to double stranded form and represent the primary normalized library.

The Soy53 (LIB3039) cDNA library is generated from soybean cultivar Asgrow 3244 (Asgrow Seed Company, Des Moines, Iowa U.S.A.) seedling shoot apical meristem tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Apical tissue is harvested from seedling shoot meristem tissue, 7-8 days after the start of imbibition. The apex of each seedling is dissected to include the fifth node to the apical meristem. The fifth node corresponds to the third trifoliate leaf in the very early stages of development. Stipules completely envelop the leaf primordia at this time. A total of 200 mg of apical tissue is harvested and immediately frozen in liquid nitrogen. The harvested tissue is then stored at −80° C. until RNA preparation.

The Soy54 (LIB3040) cDNA library is generated from soybean cultivar Asgrow 3244 (Asgrow Seed Company, Des Moines, Iowa U.S.A.) heart to torpedo stage embryo tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Seeds are collected and embryos removed from surrounding endosperm and maternal tissues. Embryos from globular to young torpedo stages (by corresponding analogy to *Arabidopsis*) are collected with a bias towards the middle of this spectrum. Embryos which are beginning to show asymmetric development of cotyledons are considered the upper developmental boundary for the collection and are excluded. A total of 12 mg embryo tissue is frozen in liquid nitrogen. The harvested tissue is stored at −80° C. until RNA preparation.

Soy55 (LIB3049) cDNA library is generated from soybean cultivar Asgrow 3244 (Asgrow Seed Company, Des Moines, Iowa U.S.A.) young seed tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Seeds are collected from very young pods (5 to 15 days after flowering). A total of 100 mg of seeds are harvested and frozen in liquid nitrogen. The harvested tissue is stored at −80° C. until RNA preparation.

Soy56 (LIB3029) cDNA library is prepared from equal amounts tissue harvested from SOYMON007, SOYMON015 and SOYMON020 prepared tissue. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio and allowed to hybridize. DNA-RNA hybrids are captured on DYNABEADS M230 streptavidin (DYNABEADS, Dynal Corporation, Lake Success, N.Y., U.S.A.). The dynabeads with captured hybrids are collected with a magnet. The non-hybridized single stranded molecules remaining after hybrid capture are not converted to double stranded form and represent a non-normalized seed pool for comparison to Soy51 cDNA libraries.

The Soy58 (LIB3050) cDNA library is generated from soybean cultivar Asgrow 3244 (Asgrow Seed Company, Des Moines, Iowa, U.S.A.) drought stressed root tissue subtracted from control root tissue. Seeds are planted at a depth of approximately 2 cm into 2-3 inch peat pots containing Metromix 350 medium and the plants are grown in an environmental chamber under 12 hr daytime/12 hr night time cycles. The daytime temperature is approximately 29° and the night time temperature 24° C. Soil is checked and watered daily to maintain even moisture conditions. At the R3 stage of the plant drought is induced by withholding water. After 3 and 6 days root tissue from both drought stressed and control (watered regularly) plants are collected and frozen in dry-ice. The harvested tissue is stored at −80° C. until RNA preparation. For subtraction, target cDNA is made from the drought stressed tissue total RNA using the SMART cDNA synthesis system from Clonetech (Clonetech Laboratories, Palo Alto, Calif., U.S.A.). Driver first strand cDNA is covalently linked to DYNADEADS following a protocol similar to that described in the Dynal literature (DYNABEADS. Dynal Corporation. Lake Success, N.Y., U.S.A.). The target cDNA is then heat denatured and the second strand trapped using DYNABEADS oligo-dT. The target second strand cDNA is then hybridized to the driver cDNA in 4.00 µl 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with DYNABEADS oligo-dT. The tapped cDNA is then amplified as in previous PCR based libraries and the resulting cDNA ligated into the pSPORT vector (Invitrogen, Carlsbad, Calif., U.S.A.).

The Soy59 (LIB3051) cDNA library is generated from soybean cultivar Asgrow 3244 (Asgrow Seed Company, Des Moines, Iowa U.S.A.) endosperm tissue. Seeds are germinated on paper towels under laboratory ambient light conditions. At 8, 10 and 14 hours after imbibition, the seed coats are harvested. The endosperm consists of a very thin layer of tissue affixed to the inside of the seed coat. The seed coat and endosperm are frozen immediately after harvest in liquid nitrogen. The harvested tissue is stored at −80° C. until RNA preparation.

The Soy60 (LIB3072) cDNA library is generated from soybean cultivar Asgrow 3244 (Asgrow Seed Company, Des Moines, Iowa, U.S.A.) drought stressed seed plus pod subtracted from control seed plus pod tissue. Seeds are planted at a depth of approximately 2 cm into 2-3 inch peat pots containing Metromix 350 medium and the plants are grown in an environmental chamber under 12 hr daytime/12 hr night time cycles. The daytime temperature is approximately 26° C. and the night time temperature 21° C. and 70% relative humidity. Soil is checked and watered daily to maintain even moisture conditions. At the R3 stage of the plant drought is induced by withholding water. After 3 and 6 days seeds and pods from both drought stressed and control (watered regularly) plants are collected from the fifth and sixth node and frozen in dry-ice. The harvested tissue is stored at −80° C. until RNA preparation. For subtraction, target cDNA is made from the drought stressed tissue total RNA using the SMART cDNA synthesis system from Clonetech (Clonetech Laboratories, Palo Alto, Calif., U.S.A.). Driver first stand cDNA is covalently linked to DYNABEADS following a protocol similar to that described in the Dynal literature (DYNABEADS Dynal Corporation, Lake Success, N.Y., U.S.A.). The target cDNA is then heat denatured and the second strand trapped using DYNABEADS oligo-dT. The target second strand cDNA is then hybridized to the driver cDNA in 400 µl 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with DYNABEADS oligo-dT. The trapped cDNA is then amplified as in previous PCR based libraries and the resulting cDNA ligated into the pSEORT vector (Invitrogen, Carlsbad, Calif., U.S.A.).

The Soy61 (LIB3073) cDNA library is generated from soybean cultivar Asgrow 3244 (Asgrow Seed Company, Des Moines, Iowa, U.S.A.) jasmonic acid treated seedling subtracted from control tissue. Seeds are planted at a depth of approximately 2 cm into 2-3 inch peat pots containing Metromix 350 medium and the plants are grown in a greenhouse. The daytime temperature is approximately 29.4° C. and the night time temperature 20° C. Soil is checked and watered daily to maintain even moisture conditions. At 9 days post planting, the plantlets are sprayed with either control buffer of 0.1% Tween-20 or jasmonic acid (Sigma J-2500, Sigma, St. Louis, Mo., U.S.A.) at 1 mg/ml in 0.1% Tween-20. Plants are sprayed until runoff and the soil and the stem is socked with the spraying solution. At 18 hours post application of jasmonic acid, the soybean plantlets appear growth retarded. After 18 hours, 24 hours and 48 hours post treatment, the cotyledons are removed and the remaining leaf and stem tissue above the soil is harvested and frozen in liquid nitrogen. The harvested tissue is stored at −80° C. until RNA preparation. To make RNA, the three sample time points were combined and ground. For subtraction, target cDNA is made from the jasmonic acid treated tissue total RNA using the SMART cDNA synthesis system from Clonetech (Clonetech Laboratories. Palo Alto, Calif., U.S.A.). Driver first strand cDNA is covalently linked to DYNABEADS following a protocol similar to that described in the Dynat literature (DYNABEADS, Dynal Corporation, Lake Success, N.Y., U.S.A.). The target cDNA is then heat denatured and the second strand trapped using DYNABEADS oligo-dT. The target second strand cDNA is then hybridized to the driver cDNA in 400 µl 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with DYNABEADS oligo-dT. The trapped cDNA is then amplified as in previous PCR based libraries and the resulting cDNA ligated into the pSPORT vector (Invitrogen, Carlsbad, Calif., U.S.A.). For this library's construction, the eighth fraction of the cDNA size fractionation step was used for ligation.

The Soy62 (LIB3074) cDNA library is generated from soybean cultivar Asgrow 3244 (Asgrow Seed Company, Des Moines, Iowa, U.S.A.) jasmonic acid treated seedling subtracted from control tissue. Seeds are planted at a depth of approximately 2 cm into 2-3 inch peat pots containing Metromix 350 medium and the plants are grown in a greenhouse. The daytime temperature is approximately 29.4° C. and the night time temperature 20° C. Soil is checked and watered daily to maintain even moisture conditions. At 9 days post planting, the plantlets are sprayed with either control buffer of 0.1% Tween-20 or jasmonic acid (Sigma J-2500, Sigma, St. Louis. Mo., U.S.A.) at 1 mg/ml in 0.1% Tween-20. Plants are sprayed until runoff and the soil and the stein is socked with the spraying solution. At 18 hours post application of jasmonic acid, the soybean plantlets appear growth retarded. After 18 hours, 24 hours and 48 hours post treatment, the cotyledons are removed and the remaining leaf and stem tissue above the soil is harvested and frozen in liquid nitrogen. The harvested tissue is stored at −80° C. until RNA preparation. To make RNA, the three sample time points were combined and ground. For subtraction, target cDNA is made from the jasmonic acid treated tissue total RNA using the SMART cDNA synthesis system from Clonetech (Clonetech Laboratories, Palo Alto, Calif., U.S.A.). Driver first strand cDNA is covalently linked to DYNABEADS following a protocol similar to that described in the Dynal literature (DYNABEADS, Dynal Corporation, Lake Success, N.Y. U.S.A.). The target cDNA is then heat denatured and the second strand trapped using DYNABEADS oligo-dT. The target second strand cDNA is then hybridized to the driver cDNA in 400 µl 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with DYNABEADS oligo-dT. The trapped cDNA is then amplified as in previous PCR based libraries and the resulting cDNA ligated into the pSPORT vector (Invitrogen, Carlsbad, Calif., U.S.A.). For this library's construction, the ninth fraction of the cDNA size fractionation step was used for ligation.

The Soy65 (LIB3107) 07cDNA library is generated from soybean cultivar Asgrow 3244 (Asgrow Seed Company, Des Moines, Iowa U.S.A.) drought-stressed abscission zone tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature 24° C. Soil is checked and watered daily to maintain even moisture conditions. Plants are irrigated with 15-16-17 Peter's Mix. At the R3 stage of development, drought is imposed by withholding water. At 3, 4, 5 and 6 days, tissue is harvested and wilting is not obvious until the fourth day. Abscission layers from reproductive organs are harvested by cutting less than one millimeter proximal and distal to the layer and immediately frozen in liquid nitrogen. The harvested tissue is stored at −80° C. until RNA preparation.

The Soy66 (LIB3109) cDNA library is generated from soybean cultivar Asgrow 3244 (Asgrow Seed Company, Des Moines, Iowa U.S.A.) non-drought stressed abscission zone tissue. Seeds are planted at a depth of approximately 2 cm into 2-3 inch peat pots containing Metromix 350 medium and the plants are grown in an environmental chamber under 12 hr daytime/12 hr nighttime cycles. The daytime temperature is approximately 29° C. and the nighttime temperature approximately 24° C. Soil is checked and watered daily to maintain even moisture conditions. Plants are irrigated with 15-16-17 Peter's Mix. At 3, 4, 5 and 6 days, control abscission layer tissue is harvested. Abscission layers from reproductive organs are harvested by cutting less than one millimeter proximal and distal to the layer and immediately frozen in liquid nitrogen. The harvested tissue is stored at −80° C. until RNA preparation.

Soy67 (LIB3065) cDNA library is prepared from equal amounts tissue harvested from SOYMON007, SOYMON015 and SOYMON020 prepared tissue. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on DYNABEADS M280 streptavidin (DYNABEADS, Dynal Corporation, Lake Success, N.Y., U.S.A.). The dynabeads with captured hybrids are collected with a magnet. Captured hybrids are eluted with water.

Soy68 (LIB3052) cDNA library is prepared from equal amounts tissue harvested from SOYMON007, SOYMON015 and SOYMON020 prepared tissue. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on DYNABEADS M230 streptavidin (DYNABEADS, Dynal Corporation, Lake Success, N.Y., U.S.A.). The dynabeads with captured hybrids are collected with a magnet. Captured hybrids are eluted with water.

Soy69 (LIB3053) cDNA library is generated from soybean cultivars Cristalina (USDA Soybean Germplasm Collection, Urbana, Ill., U.S.A.) and FT108 (Monsoy, Brazil) (tropical germ plasma) normalized leaf tissue. Leaves are harvested from plants grown in an environmental chamber under 12 hr daytime/12 hr night time cycles. The daytime temperature is approximately 29° C. and the night time temperature approximately 24° C. Soil is checked and watered daily to maintain even moisture conditions. Approximately 30 g of leaves are harvested from the C node of each of the Cristalina and FT108 cultivars and immediately frozen in dry ice. The harvested tissue is then stored at −80° C. until RNA preparation. Single stranded and double stranded DNA representing approximately $1 \times 10^6$ colony forming units are isolated using standard protocols. RNA, complementary to the single stranded DNA, is synthesized using the double stranded DNA as a template. Biotinylated dATP is incorporated into the RNA during the synthesis reaction. The single stranded DNA is mixed with the biotinylated RNA in a 1:10 molar ratio) and allowed to hybridize. DNA-RNA hybrids are captured on DYNABEADS M280 streptavidin (DYNABEADS, Dynal Corporation, Lake Success, N.Y., U.S.A.). The dynabeads with captured hybrids are collected with a magnet. The non-hybridized single stranded molecules remaining after hybrid capture are convened to double stranded form and represent the primary normalized library.

Soy70 (LIB3055) cDNA library is generated from soybean cultivars Cristalina (USDA Soybean Germplasm Collection, Urbana, Ill. U.S.A.) and FT108 (Monsoy, Brazil) (tropical germ plasma) leaf tissue. Leaves are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 30 g of leaves are harvested from the $4^{th}$ node of each of the Cristalina and FT108 cultivars and immediately frozen in dry ice. The harvested tissue is then stored at −80° C. until RNA preparation.

Soy71 (LIB3056) cDNA library is generated from soybean cultivars Cristalina and FT108 (tropical germ plasma) root tissue. Roots are harvested from plants grown in an environmental chamber under 12 hr daytime/12 hr nighttime cycles. The daytime temperature is approximately 29° C. and the nighttime temperature approximately 24° C. Soil is checked and watered daily to maintain even moisture conditions. Approximately 50 g and 56 g of roots are harvested from each of the Cristalina and FT108 cultivars and immediately frozen in dry ice. The harvested tissue is then stored at −80° C. until RNA preparation.

Soy72 (LIB3093) cDNA library is generated from soybean cultivar Asgrow 3244 (Asgrow Seed Company, Des Moines, Iowa, U.S.A.) drought stressed leaf control tissue. Seeds are planted at a depth of approximately 2 cm into 2-3 inch peat pots containing Metromix 350 medium and the plants are grown in an environmental chamber under 12 hr daytime/12 hr night time cycles. The daytime temperature is approximately 26° C. and the night time temperature 21° C. and 70% relative humidity. Soil is checked and watered daily to maintain even moisture conditions. At the R3 stage of the plant drought is induced by withholding water. After 3 and 6 days seeds and pods from both drought stressed and control (watered regularly) plants are collected from the fifth and sixth node and frozen in dry-ice. The harvested tissue is stored at −80° C. until RNA preparation. For subtraction, target cDNA is made from the drought stressed tissue total RNA using the SMART cDNA synthesis system from Clonetech (Clonerech Laboratories, Palo Alto, Calif., U.S.A.). Driver first strand cDNA is covalently linked to DYNABEADS following a protocol similar to that described in the Dynal literature (DYNABEADS, Dynal Corporation, Lake Success, N.Y., U.S.A.). The target cDNA is then heat denatured and the second strand trapped using DYNABEADS oligo-dT. The target second strand cDNA is then hybridized to the driver cDNA in 400 μl 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with DYNABEADS oligo-dT. The trapped cDNA is then amplified as in previous PCR based libraries and the resulting cDNA ligated into the pSPORT vector (Invitrogen, Carlsbad, Calif., U.S.A.).

Soy73 (LIB3093) cDNA library is generated from soybean cultivar Asgrow 3244 (Asgrow Seed Company, Des Moines, Iowa, U.S.A.) drought stressed leaf subtracted from control tissue. Seeds are planted at a depth of approximately 2 cm into 2-3 inch peat pots containing Metromix 350 medium and the plants are grown in an environmental chamber under 12 hr daytime/12 hr night time cycles. The daytime temperature is approximately 26° C. and the night time temperature 21° C. and 70% relative humidity. Soil is checked and watered daily to maintain even moisture conditions. At the R3 stage of the plant drought is induced by withholding water. After 3 and 6 days seeds and pods from both drought stressed and control (watered regularly) plants are collected from the fifth and sixth node and frozen in dry-ice. The harvested tissue is stored at −80° C. until RNA preparation. For subtraction, target cDNA is made from the drought stressed tissue total RNA using the SMART cDNA synthesis system from Clonetech (Clonetech Laboratories, Palo Alto, Calif., U.S.A.). Driver first strand cDNA is covalently linked to DYNABEADS following a protocol similar to that described in the Dynal literature (DYNABEADS, Dynal Corporation, Lake Success, N.Y., U.S.A.). The target cDNA is then heat denatured and the second strand trapped using DYNABEADS oligo-dT. The target second strand cDNA is then hybridized to the driver cDNA in 400 µl 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with DYNABEADS oligo-dT. The trapped cDNA is then amplified as in previous PCR based libraries and the resulting cDNA ligated into the pSPORT vector (Irivitrogen, Carlsbad, Calif., U.S.A.).

The Soy76 (LIB3106) cDNA library is generated from soybean cultivar Asgrow 3244 (Asgrow Seed Company, Des Moines, Iowa, U.S.A.) jasmonic acid and arachidonic treated seedling subtracted from control tissue. Seeds are planted at a depth of approximately 2 cm into 2-3 inch peat pots containing Metromix 350 medium and the plants are grown in a greenhouse. The daytime temperature is approximately 29.4° C. and the night time temperature 20° C. Soil is checked and watered daily to maintain even moisture conditions. At 9 days post planting, the plantlets are sprayed with either control buffer of 0.1% Tween-20 or jasmonic acid (Sigma J-2500, Sigma, St. Louis, Mo., U.S.A.) at 1 mg/ml in 0.1% Tween-20. Plants are sprayed until runoff and the soil and the stein is socked with the spraying solution. At 18 hours post application of jasmonic acid, the soybean plantlets appear growth retarded. Arachidonic treated seedlings are sprayed with 1 m/1 ml arachidonic acid in 0.1% Tween-20. After 18 hours, 24 hours and 48 hours post treatment, the cotyledons are removed and the remaining leaf and stem tissue above the soil is harvested and frozen in liquid nitrogen. The harvested tissue is stored at −80° C. until RNA preparation. To make RNA, the three sample time points were combined and ground. The RNA from the arachidonic treated seedlings is isolated separately. For subtraction, target cDNA is made from the jasmonic acid treated tissue total RNA using the SMART cDNA synthesis system from Clonetech (Clonetech Laboratories, Palo Alto, Calif., U.S.A.). Driver first strand cDNA is covalently linked to DYNABEADS following a protocol similar to that described in the Dynal literature (DYNABEADS, Dynal Corporation, Lake Success, N.Y., U.S.A.). The target cDNA is then heat denatured and the second strand trapped using DYNABEADS oligo-dT. The target second strand cDNA is then hybridized to the driver cDNA in 400 µl 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with DYNABEADS oligo-dT. The trapped cDNA is then amplified as in previous PCR based libraries and the resulting cDNA ligated into the pSPORT vector (Invitrogen, Carlsbad, Calif., U.S.A.). Fraction 10 of the size fractionated cDNA is ligated into the pSPGRT vector (Invitrogen, Carlsbad, Calif., U.S.A.) in order to capture some of the smaller transcripts characteristic of antifungal proteins.

Soy77 (LIB3108) cDNA library is generated from soybean cultivar Asgrow 3244 (Asgrow Seed Company, Des Moines, Iowa U.S.A.) jasmonic acid control tissue. Seeds are planted at a depth of approximately 2 cm into 2-3 inch peat pots containing Metromix 350 medium and the plants are grown in a greenhouse. The daytime temperature is approximately 29.4° C. and the night time temperature 20° C. Soil is checked and watered daily to maintain even moisture conditions. At 9 days post planting, the plantlets are sprayed with either control buffer of 0.1% Tween-20 or jasmonic acid (Sigma J-2500, Sigma, St. Louis, Mo., U.S.A.) at 1 mg/ml in 0.1% Tween-20. Plants are sprayed until runoff and the soil and the stem is socked with the spraying solution. At 18 hours post application of jasmonic acid the soybean plantlets appear growth retarded. Arachidonic treated seedlings are sprayed with 1 m/1 ml arachidonic acid in 0.1% Tween-20. After 18 hours, 24 hours and 48 hours post treatment, the cotyledons are removed and the remaining leaf and stem tissue above the soil is harvested and frozen in liquid nitrogen. The harvested tissue is stored at −80° C. until RNA preparation. To make RNA, the three sample time points were combined and ground. The RNA from the arachidonic treated seedlings is isolated separately. For subtraction, target cDNA is made from the jasmonic acid treated tissue total RNA using the SMART cDNA synthesis system from Clonetech (Clonetech Laboratories, Palo Alto, Calif., U.S.A.), Driver first strand cDNA is covalently linked to DYNABEADS following a protocol similar to that described in the Dynal literature (DYNABEADS, Dynal Corporation. Lake Success, N.Y., U.S.A.). The target cDNA is then heat denatured and the second strand trapped using DYNABEADS oligo-dT. The target second strand cDNA is then hybridized to the driver cDNA in 400 µl 2×SSPE for two rounds of hybridization at 65° C. and 20 hours. After each hybridization, the hybridization solution is removed from the system and the hybridized target cDNA removed from the driver by heat denaturation in water. After hybridization, the remaining cDNA is trapped with DYNABEADS oligo-dT. The trapped cDNA is then amplified as in previous PCR based libraries and the resulting cDNA ligated into the pSPORT vector (Invitrogen, Carlsbad, Calif., U.S.A.). Fraction 10 of the size fractionated cDNA is ligated into the pSPORT vector in order to capture some of the smaller transcripts characteristic of antifungal proteins.

The stored RNA is purified using Trizol reagent from Life Technologies (Gibco BRL, Life Technologies, Gaithersburg, Md. U.S.A.), essentially as recommended by the manufacturer, Poly A+ RNA (mRNA) is purified using magnetic oligo dT beads essentially as recommended by the manufacturer (DYNABEADS, Dynal Corporation, Lake Success, N.Y., U.S.A.).

Construction of plant cDNA libraries is well-known in the art and a number of cloning strategies exist. A number of cDNA library construction kits are commercially available. The SUPERSCRIPT Plasmid System for cDNA synthesis and Plasmid Cloning (Gibco BRL, Life Technologies, Caithersburg Md., U.S.A.) is used, following the conditions suggested by the manufacturer.

Normalized libraries are made using essentially the Soares procedure (Soares et al., *Proc. Natl. Acad. Sci.* (*U.S.A.*) 91:9228-9232 (1994), the entirety of which is herein incorporated by reference). This approach is designed to reduce the initial 10,000-fold variation in individual cDNA frequencies to achieve abundances within one order of magnitude while maintaining the overall sequence complexity of the library. In the normalization process, the prevalence of high-abundance cDNA clones decreases dramatically, clones with mid-level abundance are relatively unaffected and clones for rare transcripts are effectively increased in abundance.

Example 2

The cDNA libraries are plated on LB agar containing the appropriate antibiotics for selection and incubated at 37° for a sufficient time to allow the growth of individual colonies. Single colonies are individually placed in each well of a 96-well microtiter plates containing LB liquid including the selective antibiotics. The plates are incubated overnight at approximately 37° C. with gentle shaking to promote growth of the cultures. The plasmid DNA is isolated from each clone using Qiaprep plasmid isolation kits, using the conditions recommended by the manufacturer (Qiagen Inc., Santa Clara, Calif. U.S.A.).

Template plasmid DNA clones are used for subsequent sequencing. For sequencing, the ABI PRISM dRhodamine Terminator Cycle Sequencing Ready Reaction Kit with AmpliTaq® DNA Polymerase, FS, is used (PE Applied Biosystems, Foster City, Calif. U.S.A.).

Example 3

Nucleic acid sequences that encode for the following proteins: methionine adenosyltransferase, S-adenosylmethionine decarboxylase, aspartate kinase, aspartate-semialdehyde dehydrogenase, O-succinylhomoserine (thiol)-lyase, cystathionine β-lyase, 5-methyltetrahydropteroyltriglutamate, adenosylhomocysteinase, cystathionine β-synthase, cystathionine γ-lyase and O-acetylhomoserine (thiol)-lyase are identified from the Monsanto EST PhytoSeq database using TBLASTN (default values) (TBLASTN compares a protein query against the six reading frames of a nucleic acid sequence). Matches found with BLAST P values equal or less than 0.001 (probability) or BLAST Score of equal or greater than 90 are classified as hits. If the program used to determine the hit is HMMSW then the score refers to HMMSW score.

In addition, the GENBANK database is searched with BLASTN and BLASTX (default values) using ESTs as queries. EST that pass the hit probability threshold of $10e^{-8}$ for the following enzymes are combined with the hits generated by using TBLASTN (described above) and classified by enzyme (see Table A below).

A cluster refers to a set of overlapping clones in the PhytoSeq database. Such an overlapping relationship among clones is designated as a "cluster" when BLAST scores from pairwise sequence comparisons of the member clones meets a predetermined minimum value or product score of 50 or more (Product Score=(BLAST SCORE×Percentage Identity)/(5× minimum [length (Seq1), length (Seq2)]))

Since clusters are formed on the basis of single-linkage relationships, it is possible for two non-overlapping clones to be members of the same cluster if, for instance, they both overlap a third clone with at least the predetermined minimum BLAST score (stringency). A cluster ID is arbitrarily assigned to all of those clones which belong to the same cluster at a given stringency and a particular clone will belong to only one cluster at a given stringency. If a cluster contains only a single clone (a "singleton"), then the cluster ID number will be negative, with an absolute value equal to the clone ID number of its single member. Clones grouped in a cluster in most cases represent a contiguous sequence.

TABLE A*

METHIONINE ADENOSYLTRANSFERASE (EC 2.5.1.6)

| Seq No. | Cluster ID | CloneID | Library | NCBI gi | Method | Score | P-value | % Ident |
|---|---|---|---|---|---|---|---|---|
| 1 | -700019427 | 700019427H1 | SATMON001 | g17262 | BLASTX | 120 | 1e−11 | 92 |
| 2 | -700074004 | 700074004H1 | SATMON007 | g1778820 | BLASTN | 830 | 1e−60 | 80 |
| 3 | -700149718 | 700149718H1 | SATMON007 | g1778820 | BLASTN | 263 | 1e−13 | 80 |
| 4 | -700220251 | 700220251H1 | SATMON011 | g1127582 | BLASTN | 243 | 1e−9 | 90 |
| 5 | -700458196 | 700458196H1 | SATMON029 | g1778820 | BLASTN | 202 | 1e−22 | 88 |
| 6 | -701172459 | 701172459H1 | SATMONN05 | g882334 | BLASTN | 801 | 1e−57 | 89 |
| 7 | -L1436317 | LIB143-062-Q1-E1-B6 | LIB143 | g1778820 | BLASTN | 341 | 1e−19 | 77 |
| 8 | -L1893126 | LIB189-021-Q1-E1-F4 | LIB189 | g1778820 | BLASTN | 629 | 1e−41 | 88 |
| 9 | -L1894542 | LIB189-033-Q1-E1-H12 | LIB189 | g1778820 | BLASTN | 564 | 1e−60 | 76 |
| 10 | -L30622839 | LIB3062-028-Q1-K1-C2 | LIB3062 | g1778820 | BLASTN | 625 | 1e−65 | 74 |
| 11 | -L30671966 | LIB3067-036-Q1-K1-D8 | LIB3067 | g1655576 | BLASTX | 118 | 1e−25 | 85 |
| 12 | -L30682166 | LIB3068-004-Q1-K1-D5 | LIB3068 | g497900 | BLASTX | 111 | 1e−29 | 47 |
| 13 | 1 | LIB143-036-Q1-E1-G7 | LIB143 | g450548 | BLASTN | 1766 | 1e−138 | 88 |
| 14 | 1 | LIB3060-013-Q1-K1-F7 | LIB3060 | g1778820 | BLASTN | 1702 | 1e−133 | 90 |
| 15 | 1 | LIB143-013-Q1-E1-A6 | LIB143 | g1778820 | BLASTN | 1712 | 1e−133 | 88 |
| 16 | 1 | LIB148-007-Q1-E1-B8 | LIB148 | g450548 | BLASTN | 1693 | 1e−132 | 88 |
| 17 | 1 | LIB3079-003-Q1-K1-G1 | LIB3079 | g1778820 | BLASTN | 1236 | 1e−130 | 88 |
| 18 | 1 | LIB3066-011-Q1-K1-E4 | LIB3066 | g1778820 | BLASTN | 1661 | 1e−129 | 86 |
| 19 | 1 | LIB3068-008-Q1-K1-D2 | LIB3068 | g450548 | BLASTN | 1192 | 1e−128 | 88 |
| 20 | 1 | LIB143-061-Q1-E1-E7 | LIB143 | g1778820 | BLASTN | 1638 | 1e−127 | 88 |
| 21 | 1 | LIB189-006-Q1-E1-B2 | LIB189 | g1778820 | BLASTN | 1627 | 1e−126 | 86 |
| 22 | 1 | LIB143-031-Q1-E1-C7 | LIB143 | g450548 | BLASTN | 1595 | 1e−124 | 86 |
| 23 | 1 | LIB3068-011-Q1-K1-B12 | LIB3068 | g450548 | BLASTN | 1552 | 1e−123 | 87 |
| 24 | 1 | LIB143-013-Q1-E1-G11 | LIB143 | g450548 | BLASTN | 1585 | 1e−123 | 88 |
| 25 | 1 | LIB3062-057-Q1-K1-H9 | LIB3062 | g450548 | BLASTN | 1577 | 1e−122 | 89 |
| 26 | 1 | LIB143-008-Q1-E1-G9 | LIB143 | g450548 | BLASTN | 1556 | 1e−120 | 89 |
| 27 | 1 | LIB3068-058-Q1-K1-B7 | LIB3068 | g450548 | BLASTN | 1470 | 1e−118 | 86 |

TABLE A*-continued

METHIONINE ADENOSYLTRANSFERASE (EC 2.5.1.6)

| Seq No. | Cluster ID | CloneID | Library | NCBI gi | Method | Score | P-value | % Ident |
|---|---|---|---|---|---|---|---|---|
| 28 | 1 | LIB3067-048-Q1-K1-G5 | LIB3067 | g1778820 | BLASTN | 1518 | 1e-117 | 89 |
| 29 | 1 | LIB143-049-Q1-E1-A12 | LIB143 | g1778820 | BLASTN | 1480 | 1e-114 | 91 |
| 30 | 1 | LIB3062-010-Q1-K1-C7 | LIB3062 | g1778820 | BLASTN | 1145 | 1e-113 | 87 |
| 31 | 1 | LIB3068-055-Q1-K1-E10 | LIB3068 | g450548 | BLASTN | 1451 | 1e-112 | 88 |
| 32 | 1 | LIB189-025-Q1-E1-H1 | LIB189 | g1778820 | BLASTN | 1460 | 1e-112 | 90 |
| 33 | 1 | LIB143-066-Q1-E1-F4 | LIB143 | g1778820 | BLASTN | 1309 | 1e-111 | 86 |
| 34 | 1 | LIB143-003-Q1-E1-D10 | LIB143 | g1778820 | BLASTN | 1440 | 1e-111 | 87 |
| 35 | 1 | LIB3062-033-Q1-K1-G1 | LIB3062 | g1778820 | BLASTN | 1449 | 1e-111 | 86 |
| 36 | 1 | LIB3066-029-Q1-K1-H11 | LIB3066 | g1778820 | BLASTN | 1427 | 1e-110 | 88 |
| 37 | 1 | LIB3068-016-Q1-K1-D9 | LIB3068 | g450548 | BLASTN | 1213 | 1e-109 | 87 |
| 38 | 1 | LIB3062-027-Q1-K1-B11 | LIB3062 | g1778820 | BLASTN | 1187 | 1e-108 | 87 |
| 39 | 1 | LIB3068-048-Q1-K1-G4 | LIB3068 | g1778820 | BLASTN | 1410 | 1e-108 | 82 |
| 40 | 1 | LIB148-020-Q1-E1-B6 | LIB148 | g1778820 | BLASTN | 1088 | 1e-107 | 84 |
| 41 | 1 | LIB3066-046-Q1-K1-F2 | LIB3066 | g1778820 | BLASTN | 1400 | 1e-107 | 90 |
| 42 | 1 | 700084130H1 | SATMON011 | g1778820 | BLASTN | 960 | 1e-106 | 92 |
| 43 | 1 | 700092863H1 | SATMON008 | g1778820 | BLASTN | 1388 | 1e-106 | 92 |
| 44 | 1 | LIB3068-043-Q1-K1-A12 | LIB3068 | g450548 | BLASTN | 827 | 1e-105 | 81 |
| 45 | 1 | 700092659H1 | SATMON008 | g1778820 | BLASTN | 1359 | 1e-104 | 92 |
| 46 | 1 | LIB143-038-Q1-E1-H11 | LIB143 | g450548 | BLASTN | 1345 | 1e-103 | 84 |
| 47 | 1 | LIB3062-028-Q1-K1-F12 | LIB3062 | g1778820 | BLASTN | 1082 | 1e-102 | 82 |
| 48 | 1 | 700103135H1 | SATMON010 | g1778820 | BLASTN | 1306 | 1e-100 | 93 |
| 49 | 1 | LIB3078-050-Q1-K1-D9 | LIB3078 | g1778820 | BLASTN | 1309 | 1e-100 | 86 |
| 50 | 1 | 700084823H1 | SATMON011 | g1778820 | BLASTN | 1311 | 1e-100 | 90 |
| 51 | 1 | 700201311H1 | SATMON003 | g1778820 | BLASTN | 960 | 1e-97 | 89 |
| 52 | 1 | 700265914H1 | SATMON017 | g1778820 | BLASTN | 1275 | 1e-97 | 91 |
| 53 | 1 | 700205948H1 | SATMON003 | g1778820 | BLASTN | 983 | 1e-96 | 93 |
| 54 | 1 | LIB189-003-Q1-E1-A6 | LIB189 | g450548 | BLASTN | 1262 | 1e-96 | 86 |
| 55 | 1 | LIB143-017-Q1-E1-B9 | LIB143 | g1778820 | BLASTN | 779 | 1e-95 | 86 |
| 56 | 1 | 700097434H1 | SATMON009 | g450548 | BLASTN | 1247 | 1e-95 | 90 |
| 57 | 1 | 700089089H1 | SATMON011 | g450548 | BLASTN | 1251 | 1e-95 | 89 |
| 58 | 1 | 700071949H1 | SATMON007 | g1778820 | BLASTN | 1256 | 1e-95 | 87 |
| 59 | 1 | 700047892H1 | SATMON003 | g1778820 | BLASTN | 1236 | 1e-94 | 91 |
| 60 | 1 | 700077246H1 | SATMON007 | g450548 | BLASTN | 1237 | 1e-94 | 89 |
| 61 | 1 | 700085681H1 | SATMON011 | g1778820 | BLASTN | 1237 | 1e-94 | 89 |
| 62 | 1 | LIB3067-010-Q1-K1-A7 | LIB3067 | g1778820 | BLASTN | 1244 | 1e-94 | 83 |
| 63 | 1 | 700619961H1 | SATMON034 | g450548 | BLASTN | 962 | 1e-93 | 89 |
| 64 | 1 | 700087395H1 | SATMON011 | g450548 | BLASTN | 1040 | 1e-93 | 89 |
| 65 | 1 | 700240431H1 | SATMON010 | g1778820 | BLASTN | 1156 | 1e-93 | 92 |
| 66 | 1 | 700053822H1 | SATMON011 | g1778820 | BLASTN | 1224 | 1e-93 | 91 |
| 67 | 1 | 700103856H1 | SATMON010 | g450548 | BLASTN | 1224 | 1e-93 | 88 |
| 68 | 1 | 700083703H1 | SATMON011 | g1778820 | BLASTN | 1229 | 1e-93 | 89 |
| 69 | 1 | 700087360H1 | SATMON011 | g450548 | BLASTN | 1234 | 1e-93 | 90 |
| 70 | 1 | 700104713H1 | SATMON010 | g450548 | BLASTN | 1188 | 1e-92 | 87 |
| 71 | 1 | 700265996H1 | SATMON017 | g450548 | BLASTN | 1214 | 1e-92 | 88 |
| 72 | 1 | 700264870H1 | SATMON017 | g450548 | BLASTN | 945 | 1e-91 | 89 |
| 73 | 1 | 700219348H1 | SATMON011 | g1778820 | BLASTN | 1203 | 1e-91 | 91 |
| 74 | 1 | 700095527H1 | SATMON008 | g450548 | BLASTN | 1153 | 1e-90 | 88 |
| 75 | 1 | LIB3068-023-Q1-K1-G5 | LIB3068 | g1778820 | BLASTN | 1187 | 1e-90 | 89 |
| 76 | 1 | 700102547H1 | SATMON010 | g1778820 | BLASTN | 1194 | 1e-90 | 88 |
| 77 | 1 | 700332179H1 | SATMON019 | g450548 | BLASTN | 1054 | 1e-89 | 88 |
| 78 | 1 | 700405470H1 | SATMON029 | g450548 | BLASTN | 1071 | 1e-89 | 90 |
| 79 | 1 | LIB3069-043-Q1-K1-G2 | LIB3069 | g450548 | BLASTN | 1175 | 1e-89 | 84 |
| 80 | 1 | 700451332H1 | SATMON028 | g450548 | BLASTN | 1176 | 1e-89 | 90 |
| 81 | 1 | 700028108H1 | SATMON003 | g450548 | BLASTN | 1180 | 1e-89 | 89 |
| 82 | 1 | 700076154H1 | SATMON007 | g1778820 | BLASTN | 1180 | 1e-89 | 89 |
| 83 | 1 | 700089770H1 | SATMON011 | g450548 | BLASTN | 1185 | 1e-89 | 89 |
| 84 | 1 | 700051882H1 | SATMON003 | g1778820 | BLASTN | 844 | 1e-88 | 91 |
| 85 | 1 | 700242942H1 | SATMON010 | g1778820 | BLASTN | 1163 | 1e-88 | 91 |
| 86 | 1 | 700094996H1 | SATMON008 | g1778820 | BLASTN | 1166 | 1e-88 | 88 |
| 87 | 1 | 700476239H1 | SATMON025 | g450548 | BLASTN | 1166 | 1e-88 | 89 |
| 88 | 1 | 700219530H1 | SATMON011 | g1778820 | BLASTN | 1005 | 1e-87 | 91 |
| 89 | 1 | 700049726H1 | SATMON003 | g1778820 | BLASTN | 1041 | 1e-87 | 89 |
| 90 | 1 | 700096904H1 | SATMON008 | g1778820 | BLASTN | 1157 | 1e-87 | 86 |
| 91 | 1 | 700344026H1 | SATMON021 | g450548 | BLASTN | 1158 | 1e-87 | 88 |
| 92 | 1 | 700105590H1 | SATMON010 | g1778820 | BLASTN | 1139 | 1e-86 | 89 |
| 93 | 1 | 700465283H1 | SATMON025 | g450548 | BLASTN | 1145 | 1e-86 | 89 |
| 94 | 1 | 700104341H1 | SATMON010 | g450548 | BLASTN | 1146 | 1e-86 | 87 |
| 95 | 1 | LIB3062-021-Q1-K1-F12 | LIB3062 | g1778820 | BLASTN | 923 | 1e-85 | 78 |
| 96 | 1 | 700105246H1 | SATMON010 | g450548 | BLASTN | 930 | 1e-85 | 89 |
| 97 | 1 | 700072146H1 | SATMON007 | g1778820 | BLASTN | 1131 | 1e-85 | 91 |
| 98 | 1 | 700028553H1 | SATMON003 | g1778820 | BLASTN | 1132 | 1e-85 | 88 |
| 99 | 1 | 700451419H1 | SATMON028 | g450548 | BLASTN | 1133 | 1e-85 | 89 |
| 100 | 1 | 700103241H1 | SATMON010 | g450548 | BLASTN | 1134 | 1e-85 | 90 |
| 101 | 1 | 700612549H1 | SATMON033 | g450548 | BLASTN | 1134 | 1e-85 | 89 |
| 102 | 1 | 700050434H1 | SATMON003 | g450548 | BLASTN | 723 | 1e-84 | 89 |

TABLE A*-continued

METHIONINE ADENOSYLTRANSFERASE (EC 2.5.1.6)

| Seq No. | Cluster ID | CloneID | Library | NCBI gi | Method | Score | P-value | % Ident |
|---|---|---|---|---|---|---|---|---|
| 103 | 1 | 700094764H1 | SATMON008 | g1778820 | BLASTN | 977 | 1e−84 | 86 |
| 104 | 1 | 700163030H1 | SATMON013 | g1778820 | BLASTN | 1011 | 1e−84 | 93 |
| 105 | 1 | 700466542H1 | SATMON025 | g450548 | BLASTN | 1085 | 1e−84 | 89 |
| 106 | 1 | 700047380H1 | SATMON003 | g450548 | BLASTN | 1096 | 1e−84 | 89 |
| 107 | 1 | 700456429H1 | SATMON029 | g450548 | BLASTN | 1118 | 1e−84 | 88 |
| 108 | 1 | 700096049H1 | SATMON008 | g1778820 | BLASTN | 1122 | 1e−84 | 86 |
| 109 | 1 | 700075906H1 | SATMON007 | g1778820 | BLASTN | 838 | 1e−83 | 86 |
| 110 | 1 | LIB3067-048-Q1-K1-G3 | LIB3067 | g1778820 | BLASTN | 1045 | 1e−83 | 86 |
| 111 | 1 | 700214043H1 | SATMON016 | g450548 | BLASTN | 1103 | 1e−83 | 88 |
| 112 | 1 | 700096909H1 | SATMON008 | g1778820 | BLASTN | 1103 | 1e−83 | 90 |
| 113 | 1 | 701184635H1 | SATMONN06 | g1778820 | BLASTN | 1104 | 1e−83 | 87 |
| 114 | 1 | 700158969H1 | SATMON012 | g1778820 | BLASTN | 1107 | 1e−83 | 93 |
| 115 | 1 | 700475902H1 | SATMON025 | g450548 | BLASTN | 1112 | 1e−83 | 89 |
| 116 | 1 | 700207076H1 | SATMON003 | g1778820 | BLASTN | 1113 | 1e−83 | 90 |
| 117 | 1 | 700161901H1 | SATMON012 | g1778820 | BLASTN | 1091 | 1e−82 | 91 |
| 118 | 1 | 700452183H1 | SATMON028 | g450548 | BLASTN | 1095 | 1e−82 | 88 |
| 119 | 1 | 700452326H1 | SATMON028 | g450548 | BLASTN | 1098 | 1e−82 | 88 |
| 120 | 1 | 700106918H1 | SATMON010 | g450548 | BLASTN | 1101 | 1e−82 | 88 |
| 121 | 1 | 700220146H1 | SATMON011 | g450548 | BLASTN | 1083 | 1e−81 | 89 |
| 122 | 1 | 700221060H1 | SATMON011 | g450548 | BLASTN | 1084 | 1e−81 | 88 |
| 123 | 1 | 700243344H1 | SATMON010 | g1778820 | BLASTN | 1084 | 1e−81 | 92 |
| 124 | 1 | 700475790H1 | SATMON025 | g450548 | BLASTN | 1084 | 1e−81 | 89 |
| 125 | 1 | 700452691H1 | SATMON028 | g1778820 | BLASTN | 1086 | 1e−81 | 87 |
| 126 | 1 | 700243733H1 | SATMON010 | g450548 | BLASTN | 1086 | 1e−81 | 90 |
| 127 | 1 | LIB3059-018-Q1-K1-D10 | LIB3059 | g1778820 | BLASTN | 830 | 1e−80 | 91 |
| 128 | 1 | 700165958H1 | SATMON013 | g450548 | BLASTN | 1070 | 1e−80 | 89 |
| 129 | 1 | 700082659H1 | SATMON011 | g1778820 | BLASTN | 1071 | 1e−80 | 88 |
| 130 | 1 | 700172557H1 | SATMON013 | g1778820 | BLASTN | 1074 | 1e−80 | 92 |
| 131 | 1 | 700221526H1 | SATMON011 | g450548 | BLASTN | 1075 | 1e−80 | 88 |
| 132 | 1 | 700456696H1 | SATMON029 | g450548 | BLASTN | 1077 | 1e−80 | 89 |
| 133 | 1 | 700430776H1 | SATMONN01 | g1778820 | BLASTN | 574 | 1e−79 | 90 |
| 134 | 1 | LIB3062-025-Q1-K1-B11 | LIB3062 | g450548 | BLASTN | 585 | 1e−79 | 85 |
| 135 | 1 | 700077126H1 | SATMON007 | g1778820 | BLASTN | 743 | 1e−79 | 88 |
| 136 | 1 | 700160310H1 | SATMON012 | g1778820 | BLASTN | 752 | 1e−79 | 91 |
| 137 | 1 | 700030466H1 | SATMON003 | g1778820 | BLASTN | 757 | 1e−79 | 83 |
| 138 | 1 | 700210204H1 | SATMON016 | g1778820 | BLASTN | 844 | 1e−79 | 91 |
| 139 | 1 | 700094716H1 | SATMON008 | g1778820 | BLASTN | 857 | 1e−79 | 86 |
| 140 | 1 | 700157051H1 | SATMON012 | g1778820 | BLASTN | 937 | 1e−79 | 89 |
| 141 | 1 | 700241415H1 | SATMON010 | g450548 | BLASTN | 1055 | 1e−79 | 90 |
| 142 | 1 | 700160127H1 | SATMON012 | g450548 | BLASTN | 1056 | 1e−79 | 88 |
| 143 | 1 | 700205485H1 | SATMON003 | g1778820 | BLASTN | 1059 | 1e−79 | 90 |
| 144 | 1 | 700475930H1 | SATMON025 | g450548 | BLASTN | 1060 | 1e−79 | 89 |
| 145 | 1 | 700161902H1 | SATMON012 | g1778820 | BLASTN | 1060 | 1e−79 | 91 |
| 146 | 1 | 700213573H1 | SATMON016 | g450548 | BLASTN | 1061 | 1e−79 | 89 |
| 147 | 1 | 700207677H1 | SATMON016 | g450548 | BLASTN | 1061 | 1e−79 | 88 |
| 148 | 1 | 700581117H1 | SATMON031 | g450548 | BLASTN | 1065 | 1e−79 | 88 |
| 149 | 1 | 700451418H1 | SATMON028 | g450548 | BLASTN | 546 | 1e−78 | 89 |
| 150 | 1 | 700212606H1 | SATMON016 | g1778820 | BLASTN | 1044 | 1e−78 | 85 |
| 151 | 1 | 700222605H1 | SATMON011 | g1778820 | BLASTN | 1047 | 1e−78 | 86 |
| 152 | 1 | 700050542H1 | SATMON003 | g1778820 | BLASTN | 1053 | 1e−78 | 86 |
| 153 | 1 | 700450709H1 | SATMON028 | g450548 | BLASTN | 834 | 1e−77 | 88 |
| 154 | 1 | 700213368H1 | SATMON016 | g450548 | BLASTN | 861 | 1e−77 | 89 |
| 155 | 1 | 700095926H1 | SATMON008 | g1778820 | BLASTN | 1030 | 1e−77 | 86 |
| 156 | 1 | 700261686H1 | SATMON017 | g1778820 | BLASTN | 1034 | 1e−77 | 89 |
| 157 | 1 | 700235993H1 | SATMON010 | g450548 | BLASTN | 1037 | 1e−77 | 88 |
| 158 | 1 | 700466152H1 | SATMON025 | g450548 | BLASTN | 1038 | 1e−77 | 89 |
| 159 | 1 | 700266410H1 | SATMON017 | g1778820 | BLASTN | 1041 | 1e−77 | 85 |
| 160 | 1 | 700216991H1 | SATMON016 | g1778820 | BLASTN | 491 | 1e−76 | 92 |
| 161 | 1 | 700464957H1 | SATMON025 | g450548 | BLASTN | 607 | 1e−76 | 88 |
| 162 | 1 | 700160463H1 | SATMON012 | g1778820 | BLASTN | 1018 | 1e−76 | 91 |
| 163 | 1 | 700158224H1 | SATMON012 | g1778820 | BLASTN | 1018 | 1e−76 | 92 |
| 164 | 1 | 700469971H1 | SATMON025 | g1778820 | BLASTN | 1020 | 1e−76 | 86 |
| 165 | 1 | 700222731H1 | SATMON011 | g450548 | BLASTN | 1022 | 1e−76 | 88 |
| 166 | 1 | 700087434H1 | SATMON011 | g1778820 | BLASTN | 1023 | 1e−76 | 86 |
| 167 | 1 | 700094482H1 | SATMON008 | g1778820 | BLASTN | 1023 | 1e−76 | 86 |
| 168 | 1 | 700235976H1 | SATMON010 | g450548 | BLASTN | 1028 | 1e−76 | 89 |
| 169 | 1 | 700088266H1 | SATMON011 | g1778820 | BLASTN | 983 | 1e−75 | 92 |
| 170 | 1 | 700075882H1 | SATMON007 | g1778820 | BLASTN | 1009 | 1e−75 | 83 |
| 171 | 1 | 700243324H1 | SATMON010 | g1778820 | BLASTN | 1012 | 1e−75 | 86 |
| 172 | 1 | 700159625H2 | SATMON012 | g450548 | BLASTN | 1015 | 1e−75 | 90 |
| 173 | 1 | 700204422H1 | SATMON003 | g1778820 | BLASTN | 1015 | 1e−75 | 88 |
| 174 | 1 | 700048228H1 | SATMON003 | g1778820 | BLASTN | 741 | 1e−74 | 85 |
| 175 | 1 | 700072474H1 | SATMON007 | g1778820 | BLASTN | 799 | 1e−74 | 85 |
| 176 | 1 | 700477790H1 | SATMON025 | g450548 | BLASTN | 960 | 1e−74 | 89 |
| 177 | 1 | LIB3059-022-Q1-K1-A9 | LIB3059 | g1778820 | BLASTN | 995 | 1e−74 | 86 |

TABLE A*-continued

METHIONINE ADENOSYLTRANSFERASE (EC 2.5.1.6)

| Seq No. | Cluster ID | CloneID | Library | NCBI gi | Method | Score | P-value | % Ident |
|---|---|---|---|---|---|---|---|---|
| 178 | 1 | 700241633H1 | SATMON010 | g450548 | BLASTN | 997 | 1e-74 | 89 |
| 179 | 1 | 700093978H1 | SATMON008 | g1778820 | BLASTN | 999 | 1e-74 | 89 |
| 180 | 1 | 700238569H1 | SATMON010 | g450548 | BLASTN | 844 | 1e-73 | 88 |
| 181 | 1 | 700455160H1 | SATMON029 | g450548 | BLASTN | 849 | 1e-73 | 86 |
| 182 | 1 | 700262745H1 | SATMON017 | g1778820 | BLASTN | 984 | 1e-73 | 85 |
| 183 | 1 | 700405029H1 | SATMON027 | g1778820 | BLASTN | 990 | 1e-73 | 90 |
| 184 | 1 | 700195230H1 | SATMON014 | g450548 | BLASTN | 991 | 1e-73 | 88 |
| 185 | 1 | 700264753H1 | SATMON017 | g1778820 | BLASTN | 993 | 1e-73 | 90 |
| 186 | 1 | 700050142H1 | SATMON003 | g1778820 | BLASTN | 433 | 1e-72 | 86 |
| 187 | 1 | 700452677H1 | SATMON028 | g450548 | BLASTN | 919 | 1e-72 | 87 |
| 188 | 1 | 700168870H1 | SATMON013 | g1778820 | BLASTN | 971 | 1e-72 | 90 |
| 189 | 1 | 700023193H1 | SATMON003 | g450548 | BLASTN | 972 | 1e-72 | 88 |
| 190 | 1 | 700086582H1 | SATMON011 | g1778820 | BLASTN | 980 | 1e-72 | 84 |
| 191 | 1 | 700457710H1 | SATMON029 | g450548 | BLASTN | 982 | 1e-72 | 87 |
| 192 | 1 | 700477601H1 | SATMON025 | g450548 | BLASTN | 635 | 1e-71 | 88 |
| 193 | 1 | 700377730H1 | SATMON019 | g1778820 | BLASTN | 691 | 1e-71 | 87 |
| 194 | 1 | 700169782H1 | SATMON013 | g1778820 | BLASTN | 960 | 1e-71 | 91 |
| 195 | 1 | 700461113H1 | SATMON033 | g1778820 | BLASTN | 962 | 1e-71 | 85 |
| 196 | 1 | 700258669H1 | SATMON017 | g1778820 | BLASTN | 963 | 1e-71 | 90 |
| 197 | 1 | 700454253H1 | SATMON029 | g1778820 | BLASTN | 964 | 1e-71 | 85 |
| 198 | 1 | 700092376H1 | SATMON008 | g1778820 | BLASTN | 780 | 1e-70 | 83 |
| 199 | 1 | 700242885H1 | SATMON010 | g960356 | BLASTN | 946 | 1e-70 | 86 |
| 200 | 1 | 700094333H1 | SATMON008 | g1778820 | BLASTN | 947 | 1e-70 | 86 |
| 201 | 1 | 700575124H1 | SATMON030 | g450548 | BLASTN | 948 | 1e-70 | 82 |
| 202 | 1 | 700072544H1 | SATMON007 | g1778820 | BLASTN | 949 | 1e-70 | 86 |
| 203 | 1 | LIB143-046-Q1-E1-B5 | LIB143 | g450548 | BLASTN | 951 | 1e-70 | 87 |
| 204 | 1 | 700096534H1 | SATMON008 | g1778820 | BLASTN | 956 | 1e-70 | 85 |
| 205 | 1 | 700262906H1 | SATMON017 | g1778820 | BLASTN | 937 | 1e-69 | 87 |
| 206 | 1 | 700094478H1 | SATMON008 | g1778820 | BLASTN | 939 | 1e-69 | 90 |
| 207 | 1 | 700172985H1 | SATMON013 | g450548 | BLASTN | 939 | 1e-69 | 88 |
| 208 | 1 | 700097938H1 | SATMON009 | g1778820 | BLASTN | 941 | 1e-69 | 85 |
| 209 | 1 | LIB3069-006-Q1-K1-D5 | LIB3069 | g450548 | BLASTN | 943 | 1e-69 | 88 |
| 210 | 1 | 700093125H1 | SATMON008 | g1778820 | BLASTN | 945 | 1e-69 | 88 |
| 211 | 1 | 700424156H1 | SATMONN01 | g450548 | BLASTN | 752 | 1e-68 | 85 |
| 212 | 1 | 700405486H1 | SATMON029 | g450548 | BLASTN | 864 | 1e-68 | 91 |
| 213 | 1 | LIB189-026-Q1-E1-H12 | LIB189 | g1778820 | BLASTN | 879 | 1e-68 | 87 |
| 214 | 1 | 700106172H1 | SATMON010 | g1778820 | BLASTN | 925 | 1e-68 | 85 |
| 215 | 1 | 700096890H1 | SATMON008 | g1778820 | BLASTN | 926 | 1e-68 | 90 |
| 216 | 1 | 700154404H1 | SATMON007 | g450548 | BLASTN | 928 | 1e-68 | 89 |
| 217 | 1 | 700468337H1 | SATMON025 | g450548 | BLASTN | 445 | 1e-67 | 88 |
| 218 | 1 | 700158827H1 | SATMON012 | g1778820 | BLASTN | 522 | 1e-67 | 87 |
| 219 | 1 | 700241744H1 | SATMON010 | g1778820 | BLASTN | 575 | 1e-67 | 85 |
| 220 | 1 | 700624633H1 | SATMON034 | g960356 | BLASTN | 644 | 1e-67 | 85 |
| 221 | 1 | 700154564H1 | SATMON007 | g1778820 | BLASTN | 735 | 1e-67 | 85 |
| 222 | 1 | 700172424H1 | SATMON013 | g450548 | BLASTN | 912 | 1e-67 | 90 |
| 223 | 1 | 700096287H1 | SATMON008 | g1778820 | BLASTN | 914 | 1e-67 | 86 |
| 224 | 1 | 700207638H1 | SATMON016 | g1778820 | BLASTN | 914 | 1e-67 | 86 |
| 225 | 1 | 700093735H1 | SATMON008 | g960356 | BLASTN | 920 | 1e-67 | 89 |
| 226 | 1 | 700159494H1 | SATMON012 | g1778820 | BLASTN | 899 | 1e-66 | 89 |
| 227 | 1 | 700236013H1 | SATMON010 | g1778820 | BLASTN | 900 | 1e-66 | 83 |
| 228 | 1 | 700220267H1 | SATMON011 | g1778820 | BLASTN | 439 | 1e-65 | 84 |
| 229 | 1 | 700477578H1 | SATMON025 | g450548 | BLASTN | 576 | 1e-65 | 90 |
| 230 | 1 | 700047743H1 | SATMON003 | g1778820 | BLASTN | 601 | 1e-65 | 82 |
| 231 | 1 | 700343041H1 | SATMON021 | g1778820 | BLASTN | 633 | 1e-65 | 86 |
| 232 | 1 | 700159886H1 | SATMON012 | g450548 | BLASTN | 803 | 1e-65 | 85 |
| 233 | 1 | 700570242H1 | SATMON030 | g450548 | BLASTN | 834 | 1e-65 | 85 |
| 234 | 1 | 700021930H1 | SATMON001 | g1778820 | BLASTN | 888 | 1e-65 | 87 |
| 235 | 1 | 700454959H1 | SATMON029 | g450548 | BLASTN | 890 | 1e-65 | 89 |
| 236 | 1 | 700171336H1 | SATMON013 | g1778820 | BLASTN | 890 | 1e-65 | 89 |
| 237 | 1 | 700105361H1 | SATMON010 | g1778820 | BLASTN | 806 | 1e-64 | 87 |
| 238 | 1 | LIB3068-031-Q1-K1-B1 | LIB3068 | g450548 | BLASTN | 853 | 1e-64 | 89 |
| 239 | 1 | 700236324H1 | SATMON010 | g450548 | BLASTN | 875 | 1e-64 | 89 |
| 240 | 1 | 700150620H1 | SATMON007 | g450548 | BLASTN | 880 | 1e-64 | 87 |
| 241 | 1 | 700220648H1 | SATMON011 | g450548 | BLASTN | 881 | 1e-64 | 90 |
| 242 | 1 | 700150733H1 | SATMON007 | g450548 | BLASTN | 881 | 1e-64 | 85 |
| 243 | 1 | 700157367H1 | SATMON012 | g1778820 | BLASTN | 882 | 1e-64 | 85 |
| 244 | 1 | 700259676H1 | SATMON017 | g1778820 | BLASTN | 885 | 1e-64 | 88 |
| 245 | 1 | 700616490H1 | SATMON033 | g450548 | BLASTN | 886 | 1e-64 | 82 |
| 246 | 1 | 700102511H1 | SATMON010 | g450548 | BLASTN | 695 | 1e-63 | 89 |
| 247 | 1 | 700202805H1 | SATMON003 | g1778820 | BLASTN | 817 | 1e-63 | 92 |
| 248 | 1 | 700105685H1 | SATMON010 | g1778820 | BLASTN | 866 | 1e-63 | 84 |
| 249 | 1 | 700106113H1 | SATMON010 | g450548 | BLASTN | 873 | 1e-63 | 91 |
| 250 | 1 | 700444778H1 | SATMON027 | g1778820 | BLASTN | 343 | 1e-62 | 84 |
| 251 | 1 | 700103584H1 | SATMON010 | g450548 | BLASTN | 521 | 1e-62 | 86 |
| 252 | 1 | LIB189-008-Q1-E1-D9 | LIB189 | g1778820 | BLASTN | 850 | 1e-62 | 91 |

TABLE A*-continued

METHIONINE ADENOSYLTRANSFERASE (EC 2.5.1.6)

| Seq No. | Cluster ID | CloneID | Library | NCBI gi | Method | Score | P-value | % Ident |
|---|---|---|---|---|---|---|---|---|
| 253 | 1 | 700155684H1 | SATMON007 | g1778820 | BLASTN | 852 | 1e-62 | 85 |
| 254 | 1 | 700261639H1 | SATMON017 | g1778820 | BLASTN | 853 | 1e-62 | 89 |
| 255 | 1 | 700158367H1 | SATMON012 | g450548 | BLASTN | 856 | 1e-62 | 81 |
| 256 | 1 | 700153242H1 | SATMON007 | g1778820 | BLASTN | 859 | 1e-62 | 90 |
| 257 | 1 | 700210738H1 | SATMON016 | g1778820 | BLASTN | 859 | 1e-62 | 90 |
| 258 | 1 | 700203008H1 | SATMON003 | g450548 | BLASTN | 698 | 1e-61 | 86 |
| 259 | 1 | 700206081H1 | SATMON003 | g1778820 | BLASTN | 840 | 1e-61 | 92 |
| 260 | 1 | 700028643H1 | SATMON003 | g1778820 | BLASTN | 846 | 1e-61 | 85 |
| 261 | 1 | 700223914H1 | SATMON011 | g1778820 | BLASTN | 849 | 1e-61 | 84 |
| 262 | 1 | 700571455H1 | SATMON030 | g1778820 | BLASTN | 378 | 1e-60 | 88 |
| 263 | 1 | 700075374H1 | SATMON007 | g1778820 | BLASTN | 830 | 1e-60 | 85 |
| 264 | 1 | 700150452H1 | SATMON007 | g450548 | BLASTN | 831 | 1e-60 | 89 |
| 265 | 1 | 700261318H1 | SATMON017 | g1778820 | BLASTN | 831 | 1e-60 | 83 |
| 266 | 1 | 700616390H1 | SATMON033 | g450548 | BLASTN | 835 | 1e-60 | 92 |
| 267 | 1 | 700208718H1 | SATMON016 | g450548 | BLASTN | 561 | 1e-59 | 89 |
| 268 | 1 | 700448948H1 | SATMON028 | g1778820 | BLASTN | 653 | 1e-59 | 83 |
| 269 | 1 | LIB3060-035-Q1-K1-H3 | LIB3060 | g450548 | BLASTN | 734 | 1e-59 | 85 |
| 270 | 1 | 700049753H1 | SATMON003 | g450548 | BLASTN | 769 | 1e-59 | 90 |
| 271 | 1 | 700154489H1 | SATMON007 | g1778820 | BLASTN | 814 | 1e-59 | 83 |
| 272 | 1 | 700170783H1 | SATMON013 | g1778820 | BLASTN | 816 | 1e-59 | 87 |
| 273 | 1 | 700237571H1 | SATMON010 | g450548 | BLASTN | 817 | 1e-59 | 89 |
| 274 | 1 | 700154872H1 | SATMON007 | g1778820 | BLASTN | 822 | 1e-59 | 85 |
| 275 | 1 | 700025620H1 | SATMON004 | g1778820 | BLASTN | 686 | 1e-58 | 84 |
| 276 | 1 | 700158255H1 | SATMON012 | g450548 | BLASTN | 803 | 1e-58 | 86 |
| 277 | 1 | 700159282H1 | SATMON012 | g450548 | BLASTN | 805 | 1e-58 | 83 |
| 278 | 1 | 700222171H1 | SATMON011 | g1778820 | BLASTN | 807 | 1e-58 | 89 |
| 279 | 1 | 700205003H1 | SATMON003 | g1778820 | BLASTN | 441 | 1e-57 | 86 |
| 280 | 1 | 700049209H1 | SATMON003 | g1778820 | BLASTN | 443 | 1e-57 | 90 |
| 281 | 1 | 700016430H1 | SATMON001 | g1778820 | BLASTN | 492 | 1e-57 | 86 |
| 282 | 1 | 700212936H1 | SATMON016 | g450548 | BLASTN | 564 | 1e-57 | 86 |
| 283 | 1 | 700156939H1 | SATMON012 | g1778820 | BLASTN | 801 | 1e-57 | 84 |
| 284 | 1 | 700222183H1 | SATMON011 | g1778820 | BLASTN | 561 | 1e-56 | 83 |
| 285 | 1 | 700203453H1 | SATMON003 | g1778820 | BLASTN | 784 | 1e-56 | 90 |
| 286 | 1 | 700167708H1 | SATMON013 | g1778820 | BLASTN | 560 | 1e-55 | 83 |
| 287 | 1 | 700214356H1 | SATMON016 | g1778820 | BLASTN | 693 | 1e-55 | 87 |
| 288 | 1 | 700475377H1 | SATMON025 | g450548 | BLASTN | 705 | 1e-55 | 90 |
| 289 | 1 | 700029625H1 | SATMON003 | g450548 | BLASTN | 712 | 1e-55 | 88 |
| 290 | 1 | 700202091H1 | SATMON003 | g1778820 | BLASTN | 774 | 1e-55 | 90 |
| 291 | 1 | 700264594H1 | SATMON017 | g450548 | BLASTN | 775 | 1e-55 | 89 |
| 292 | 1 | 700074969H1 | SATMON007 | g450548 | BLASTN | 777 | 1e-55 | 87 |
| 293 | 1 | LIB3068-005-Q1-K1-A9 | LIB3068 | g1778820 | BLASTN | 389 | 1e-54 | 80 |
| 294 | 1 | 700207147H1 | SATMON017 | g1778820 | BLASTN | 537 | 1e-54 | 88 |
| 295 | 1 | LIB189-004-Q1-E1-F11 | LIB189 | g960356 | BLASTN | 757 | 1e-54 | 87 |
| 296 | 1 | 700171222H1 | SATMON013 | g1778820 | BLASTN | 757 | 1e-54 | 93 |
| 297 | 1 | 700239903H1 | SATMON010 | g1778820 | BLASTN | 760 | 1e-54 | 84 |
| 298 | 1 | 700048208H1 | SATMON003 | g1778820 | BLASTN | 762 | 1e-54 | 90 |
| 299 | 1 | 700264085H1 | SATMON017 | g450548 | BLASTN | 764 | 1e-54 | 87 |
| 300 | 1 | 700155761H1 | SATMON007 | g1778820 | BLASTN | 579 | 1e-53 | 85 |
| 301 | 1 | 700216516H1 | SATMON016 | g450548 | BLASTN | 380 | 1e-52 | 89 |
| 302 | 1 | LIB3068-044-Q1-K1-F12 | LIB3068 | g450548 | BLASTN | 492 | 1e-52 | 73 |
| 303 | 1 | 700344420H1 | SATMON021 | g450548 | BLASTN | 534 | 1e-52 | 79 |
| 304 | 1 | 700219767H1 | SATMON011 | g450548 | BLASTN | 732 | 1e-52 | 88 |
| 305 | 1 | 700153757H1 | SATMON007 | g1778820 | BLASTN | 737 | 1e-52 | 89 |
| 306 | 1 | 700165841H1 | SATMON013 | g450548 | BLASTN | 738 | 1e-52 | 90 |
| 307 | 1 | 700381966H1 | SATMON023 | g1778820 | BLASTN | 740 | 1e-52 | 86 |
| 308 | 1 | 700170427H1 | SATMON013 | g450548 | BLASTN | 687 | 1e-51 | 89 |
| 309 | 1 | 700094344H1 | SATMON008 | g1778820 | BLASTN | 725 | 1e-51 | 93 |
| 310 | 1 | 700052248H1 | SATMON003 | g1778820 | BLASTN | 726 | 1e-51 | 84 |
| 311 | 1 | 700050628H1 | SATMON003 | g450548 | BLASTN | 726 | 1e-51 | 89 |
| 312 | 1 | 700223031H1 | SATMON011 | g1778820 | BLASTN | 729 | 1e-51 | 89 |
| 313 | 1 | 700475686H1 | SATMON025 | g450548 | BLASTN | 660 | 1e-50 | 89 |
| 314 | 1 | 700170325H1 | SATMON013 | g2305013 | BLASTN | 709 | 1e-50 | 82 |
| 315 | 1 | 700221107H1 | SATMON011 | g450548 | BLASTN | 698 | 1e-49 | 89 |
| 316 | 1 | 700612589H1 | SATMON033 | g960356 | BLASTN | 703 | 1e-49 | 89 |
| 317 | 1 | 700153770H1 | SATMON007 | g1778820 | BLASTN | 705 | 1e-49 | 88 |
| 318 | 1 | LIB3078-006-Q1-K1-E7 | LIB3078 | g1778820 | BLASTN | 705 | 1e-49 | 79 |
| 319 | 1 | 700239724H1 | SATMON010 | g1778820 | BLASTN | 507 | 1e-48 | 78 |
| 320 | 1 | 700356777H1 | SATMON024 | g1778820 | BLASTN | 683 | 1e-48 | 86 |
| 321 | 1 | 700241568H1 | SATMON010 | g960356 | BLASTN | 691 | 1e-48 | 88 |
| 322 | 1 | 700051294H1 | SATMON003 | g1778820 | BLASTN | 462 | 1e-47 | 88 |
| 323 | 1 | 700343661H1 | SATMON021 | g450548 | BLASTN | 507 | 1e-47 | 81 |
| 324 | 1 | 700029419H1 | SATMON003 | g1778820 | BLASTN | 547 | 1e-47 | 87 |
| 325 | 1 | 700165936H1 | SATMON013 | g1778820 | BLASTN | 671 | 1e-47 | 83 |
| 326 | 1 | 700026152H1 | SATMON003 | g960356 | BLASTN | 673 | 1e-47 | 89 |
| 327 | 1 | 700075671H1 | SATMON007 | g450548 | BLASTN | 429 | 1e-46 | 89 |

TABLE A*-continued

METHIONINE ADENOSYLTRANSFERASE (EC 2.5.1.6)

| Seq No. | Cluster ID | CloneID | Library | NCBI gi | Method | Score | P-value | % Ident |
|---|---|---|---|---|---|---|---|---|
| 328 | 1 | 700156674H1 | SATMON012 | g1778820 | BLASTN | 659 | 1e-46 | 91 |
| 329 | 1 | 700094981H1 | SATMON008 | g1778820 | BLASTN | 662 | 1e-46 | 85 |
| 330 | 1 | 700092879H1 | SATMON008 | g1778820 | BLASTN | 668 | 1e-46 | 87 |
| 331 | 1 | 700240685H1 | SATMON010 | g1778820 | BLASTN | 484 | 1e-45 | 84 |
| 332 | 1 | 700150286H1 | SATMON007 | g1778820 | BLASTN | 647 | 1e-45 | 82 |
| 333 | 1 | 700104990H1 | SATMON010 | g450548 | BLASTN | 652 | 1e-45 | 89 |
| 334 | 1 | 700203829H1 | SATMON003 | g450548 | BLASTN | 652 | 1e-45 | 87 |
| 335 | 1 | 700153718H1 | SATMON007 | g167961 | BLASTN | 656 | 1e-45 | 91 |
| 336 | 1 | 700050841H1 | SATMON003 | g450548 | BLASTN | 571 | 1e-44 | 86 |
| 337 | 1 | 700268037H1 | SATMON017 | g2305013 | BLASTN | 636 | 1e-44 | 86 |
| 338 | 1 | 700153630H1 | SATMON007 | g1778820 | BLASTN | 637 | 1e-44 | 82 |
| 339 | 1 | 700475317H1 | SATMON025 | g450548 | BLASTN | 530 | 1e-43 | 87 |
| 340 | 1 | 701163127H1 | SATMONN04 | g960356 | BLASTN | 626 | 1e-43 | 88 |
| 341 | 1 | 700203688H1 | SATMON003 | g960356 | BLASTN | 627 | 1e-43 | 89 |
| 342 | 1 | 700049893H1 | SATMON003 | g1778820 | BLASTN | 506 | 1e-42 | 90 |
| 343 | 1 | 700449155H1 | SATMON028 | g1778820 | BLASTN | 443 | 1e-41 | 85 |
| 344 | 1 | 701183780H1 | SATMONN06 | g450548 | BLASTN | 558 | 1e-41 | 86 |
| 345 | 1 | 700242162H1 | SATMON010 | g1778820 | BLASTN | 600 | 1e-41 | 90 |
| 346 | 1 | 700466994H1 | SATMON025 | g450548 | BLASTN | 604 | 1e-41 | 91 |
| 347 | 1 | 700259823H1 | SATMON017 | g450548 | BLASTN | 607 | 1e-41 | 83 |
| 348 | 1 | 700346242H1 | SATMON021 | g450548 | BLASTN | 608 | 1e-41 | 86 |
| 349 | 1 | 700156395H1 | SATMON007 | g1778820 | BLASTN | 609 | 1e-41 | 90 |
| 350 | 1 | 700236835H1 | SATMON010 | g1778820 | BLASTN | 335 | 1e-40 | 81 |
| 351 | 1 | 700172385H1 | SATMON013 | g1778820 | BLASTN | 397 | 1e-40 | 87 |
| 352 | 1 | 700210466H1 | SATMON016 | g1778820 | BLASTN | 586 | 1e-40 | 81 |
| 353 | 1 | 700257303H1 | SATMON017 | g1778820 | BLASTN | 589 | 1e-40 | 81 |
| 354 | 1 | LIB3067-027-Q1-K1-G1 | LIB3067 | g1778820 | BLASTN | 623 | 1e-40 | 87 |
| 355 | 1 | LIB3066-025-Q1-K1-D1 | LIB3066 | g450548 | BLASTN | 524 | 1e-39 | 85 |
| 356 | 1 | 700106853H1 | SATMON012 | g450548 | BLASTN | 580 | 1e-39 | 86 |
| 357 | 1 | 700160540H1 | SATMON012 | g960356 | BLASTN | 581 | 1e-39 | 88 |
| 358 | 1 | 700157780H1 | SATMON012 | g960356 | BLASTN | 581 | 1e-39 | 88 |
| 359 | 1 | 700149801H1 | SATMON007 | g450548 | BLASTN | 565 | 1e-38 | 86 |
| 360 | 1 | 700353243H1 | SATMON024 | g450548 | BLASTN | 570 | 1e-38 | 86 |
| 361 | 1 | 700166171H1 | SATMON013 | g1778820 | BLASTN | 254 | 1e-37 | 79 |
| 362 | 1 | 700142509H1 | SATMON012 | g960356 | BLASTN | 556 | 1e-37 | 88 |
| 363 | 1 | 700242131H1 | SATMON010 | g450548 | BLASTN | 560 | 1e-37 | 85 |
| 364 | 1 | 700455643H1 | SATMON029 | g450548 | BLASTN | 539 | 1e-36 | 86 |
| 365 | 1 | 700150248H1 | SATMON007 | g1778820 | BLASTN | 547 | 1e-36 | 87 |
| 366 | 1 | 700208549H1 | SATMON016 | g450548 | BLASTN | 559 | 1e-36 | 88 |
| 367 | 1 | 700027193H1 | SATMON003 | g450548 | BLASTN | 529 | 1e-35 | 86 |
| 368 | 1 | 700221390H1 | SATMON011 | g450548 | BLASTN | 530 | 1e-35 | 85 |
| 369 | 1 | 700455647H1 | SATMON029 | g450548 | BLASTN | 531 | 1e-35 | 85 |
| 370 | 1 | 700260103H1 | SATMON017 | g1778820 | BLASTN | 531 | 1e-35 | 80 |
| 371 | 1 | 700167344H1 | SATMON013 | g1778820 | BLASTN | 536 | 1e-35 | 88 |
| 372 | 1 | 700089913H1 | SATMON011 | g960356 | BLASTN | 546 | 1e-35 | 88 |
| 373 | 1 | 700570573H1 | SATMON030 | g450548 | BLASTN | 300 | 1e-34 | 89 |
| 374 | 1 | 700169889H1 | SATMON013 | g1778820 | BLASTN | 519 | 1e-34 | 89 |
| 375 | 1 | 700262857H1 | SATMON017 | g1778820 | BLASTN | 521 | 1e-34 | 87 |
| 376 | 1 | 700142644H2 | SATMON013 | g1778820 | BLASTN | 522 | 1e-34 | 87 |
| 377 | 1 | 700224417H1 | SATMON011 | g450548 | BLASTN | 522 | 1e-34 | 91 |
| 378 | 1 | 700073882H1 | SATMON007 | g450548 | BLASTN | 531 | 1e-34 | 87 |
| 379 | 1 | 700085803H1 | SATMON011 | g450548 | BLASTN | 338 | 1e-33 | 89 |
| 380 | 1 | 700162323H1 | SATMON012 | g1778820 | BLASTN | 513 | 1e-33 | 86 |
| 381 | 1 | 700468306H1 | SATMON025 | g450548 | BLASTN | 519 | 1e-33 | 89 |
| 382 | 1 | 700443224H2 | SATMON026 | g450548 | BLASTN | 275 | 1e-32 | 83 |
| 383 | 1 | LIB3066-054-Q1-K1-E3 | LIB3066 | g450548 | BLASTN | 495 | 1e-32 | 87 |
| 384 | 1 | 700211827H1 | SATMON016 | g1778820 | BLASTN | 489 | 1e-31 | 80 |
| 385 | 1 | 700048741H1 | SATMON003 | g450548 | BLASTN | 500 | 1e-31 | 88 |
| 386 | 1 | 700613620H1 | SATMON033 | g450548 | BLASTN | 385 | 1e-30 | 88 |
| 387 | 1 | 700029203H1 | SATMON003 | g1778820 | BLASTN | 461 | 1e-29 | 84 |
| 388 | 1 | 700378431H1 | SATMON020 | g450548 | BLASTN | 466 | 1e-29 | 89 |
| 389 | 1 | 700455641H1 | SATMON029 | g450548 | BLASTN | 472 | 1e-29 | 85 |
| 390 | 1 | 700447867H1 | SATMON027 | g960356 | BLASTN | 473 | 1e-29 | 88 |
| 391 | 1 | 700447511H1 | SATMON027 | g450548 | BLASTN | 474 | 1e-29 | 88 |
| 392 | 1 | 700025851H1 | SATMON003 | g450548 | BLASTN | 479 | 1e-29 | 88 |
| 393 | 1 | LIB3066-024-Q1-K1-H4 | LIB3066 | g1778820 | BLASTN | 481 | 1e-29 | 81 |
| 394 | 1 | LIB143-025-Q1-E1-C4 | LIB143 | g450549 | BLASTX | 64 | 1e-28 | 70 |
| 395 | 1 | 700242282H1 | SATMON010 | g1778820 | BLASTN | 280 | 1e-28 | 85 |
| 396 | 1 | 700087244H1 | SATMON011 | g450548 | BLASTN | 464 | 1e-28 | 88 |
| 397 | 1 | 700458127H1 | SATMON029 | g450548 | BLASTN | 238 | 1e-27 | 82 |
| 398 | 1 | 700025767H1 | SATMON003 | g1778820 | BLASTN | 438 | 1e-26 | 86 |
| 399 | 1 | 700235401H1 | SATMON010 | g450548 | BLASTN | 442 | 1e-26 | 88 |
| 400 | 1 | 700029457H1 | SATMON003 | g450548 | BLASTN | 446 | 1e-26 | 89 |
| 401 | 1 | 700266174H1 | SATMON017 | g450548 | BLASTN | 447 | 1e-26 | 89 |
| 402 | 1 | 700349254H1 | SATMON023 | g1778820 | BLASTN | 315 | 1e-25 | 85 |

TABLE A*-continued

METHIONINE ADENOSYLTRANSFERASE (EC 2.5.1.6)

| Seq No. | Cluster ID | CloneID | Library | NCBI gi | Method | Score | P-value | % Ident |
|---|---|---|---|---|---|---|---|---|
| 403 | 1 | LIB3068-041-Q1-K1-H6 | LIB3068 | g450548 | BLASTN | 438 | 1e−25 | 86 |
| 404 | 1 | 700092889H1 | SATMON008 | g1778820 | BLASTN | 397 | 1e−24 | 92 |
| 405 | 1 | 700049044H1 | SATMON003 | g1778820 | BLASTN | 425 | 1e−24 | 90 |
| 406 | 1 | 700202710H1 | SATMON003 | g960357 | BLASTX | 114 | 1e−19 | 97 |
| 407 | 1 | 700155117H1 | SATMON007 | g450548 | BLASTN | 314 | 1e−19 | 90 |
| 408 | 1 | 700449619H1 | SATMON028 | g1778820 | BLASTN | 341 | 1e−19 | 89 |
| 409 | 1 | 700150336H1 | SATMON007 | g1778820 | BLASTN | 343 | 1e−19 | 87 |
| 410 | 1 | 700166223H1 | SATMON013 | g960357 | BLASTX | 181 | 1e−18 | 97 |
| 411 | 1 | 700153796H1 | SATMON007 | g2305013 | BLASTN | 300 | 1e−16 | 82 |
| 412 | 1 | 700053266H1 | SATMON008 | g450548 | BLASTN | 292 | 1e−15 | 83 |
| 413 | 1 | 700405227H1 | SATMON028 | g450548 | BLASTN | 313 | 1e−15 | 90 |
| 414 | 1 | 700397410H1 | SATMONN01 | g17262 | BLASTX | 147 | 1e−14 | 96 |
| 415 | 1 | 700211524H1 | SATMON016 | g1033190 | BLASTX | 153 | 1e−14 | 100 |
| 416 | 1 | 700281415H2 | SATMON019 | g2315140 | BLASTX | 139 | 1e−13 | 89 |
| 417 | 1 | 700429873H1 | SATMONN01 | g16961 | BLASTX | 133 | 1e−12 | 94 |
| 418 | 1 | 700239660H1 | SATMON010 | g450548 | BLASTN | 245 | 1e−12 | 86 |
| 419 | 1 | 700213596H1 | SATMON016 | g450548 | BLASTN | 258 | 1e−12 | 95 |
| 420 | 1 | 700152367H1 | SATMON007 | g450548 | BLASTN | 273 | 1e−12 | 88 |
| 421 | 1 | 700452014H1 | SATMON028 | g17262 | BLASTX | 76 | 1e−11 | 72 |
| 422 | 1 | 700357106H1 | SATMON024 | g1724104 | BLASTX | 132 | 1e−11 | 100 |
| 423 | 1 | 700468611H1 | SATMON025 | g450549 | BLASTX | 93 | 1e−10 | 93 |
| 424 | 1 | 700213526H1 | SATMON016 | g450549 | BLASTX | 127 | 1e−10 | 96 |
| 425 | 1 | 700267065H1 | SATMON017 | g450549 | BLASTX | 130 | 1e−10 | 96 |
| 426 | 1 | 700152044H1 | SATMON007 | g450549 | BLASTX | 88 | 1e−8 | 93 |
| 427 | 1 | 700159090H1 | SATMON012 | g169665 | BLASTX | 113 | 1e−8 | 81 |
| 428 | 1 | 700266734H1 | SATMON017 | g450549 | BLASTX | 119 | 1e−8 | 96 |
| 429 | 1 | 700405367H1 | SATMON029 | g1778820 | BLASTN | 231 | 1e−8 | 65 |
| 1635 | -700555532 | 700555532H1 | SOYMON001 | g429103 | BLASTN | 920 | 1e−67 | 84 |
| 1636 | -700649594 | 700649594H1 | SOYMON003 | g609224 | BLASTX | 186 | 1e−23 | 85 |
| 1637 | -700750590 | 700750590H1 | SOYMON014 | g609224 | BLASTN | 363 | 1e−40 | 79 |
| 1638 | -700755802 | 700755802H1 | SOYMON014 | g609224 | BLASTN | 479 | 1e−43 | 74 |
| 1639 | -700869211 | 700869211H1 | SOYMON016 | g169665 | BLASTX | 146 | 1e−13 | 92 |
| 1640 | -700891960 | 700891960H1 | SOYMON024 | g726031 | BLASTN | 589 | 1e−56 | 82 |
| 1641 | -700900377 | 700900377H1 | SOYMON027 | g1655577 | BLASTN | 235 | 1e−8 | 78 |
| 1642 | -700902427 | 700902427H1 | SOYMON027 | g1655576 | BLASTX | 151 | 1e−13 | 76 |
| 1643 | -700941686 | 700941686H1 | SOYMON024 | g497899 | BLASTN | 442 | 1e−26 | 89 |
| 1644 | -700952418 | 700952418H1 | SOYMON022 | g726030 | BLASTX | 146 | 1e−17 | 83 |
| 1645 | -700979651 | 700979651H2 | SOYMON009 | g1655579 | BLASTN | 1006 | 1e−75 | 84 |
| 1646 | -700982809 | 700982809H1 | SOYMON009 | g1655579 | BLASTN | 945 | 1e−69 | 82 |
| 1647 | -700982867 | 700982867H1 | SOYMON009 | g1127582 | BLASTN | 868 | 1e−63 | 78 |
| 1648 | -701056884 | 701056884H1 | SOYMON032 | g609556 | BLASTN | 726 | 1e−51 | 84 |
| 1649 | -701117318 | 701117318H1 | SOYMON037 | g609224 | BLASTN | 451 | 1e−37 | 80 |
| 1650 | -701118224 | 701118224H1 | SOYMON037 | g2305013 | BLASTN | 285 | 1e−19 | 72 |
| 1651 | -701121264 | 701121264H1 | SOYMON037 | g166873 | BLASTN | 238 | 1e−8 | 82 |
| 1652 | -701122908 | 701122908H1 | SOYMON037 | g16508 | BLASTN | 444 | 1e−26 | 83 |
| 1653 | -701128589 | 701128589H1 | SOYMON037 | g16508 | BLASTN | 539 | 1e−36 | 90 |
| 1654 | -GM12798 | LIB3049-039-Q1-E1-F2 | LIB3049 | g16508 | BLASTN | 578 | 1e−37 | 73 |
| 1655 | -GM14331 | LIB3049-055-Q1-E1-F5 | LIB3049 | g167961 | BLASTN | 497 | 1e−30 | 62 |
| 1656 | -GM30881 | LIB3050-005-Q1-K1-G1 | LIB3050 | g1655577 | BLASTN | 543 | 1e−34 | 82 |
| 1657 | -GM30911 | LIB3050-005-Q1-K1-B8 | LIB3050 | g1655577 | BLASTN | 387 | 1e−21 | 71 |
| 1658 | -GM33921 | LIB3051-028-Q1-K1-A9 | LIB3051 | g16508 | BLASTN | 338 | 1e−32 | 73 |
| 1659 | 12644 | 701131794H1 | SOYMON038 | g429107 | BLASTN | 877 | 1e−64 | 84 |
| 1660 | 12644 | 701142515H1 | SOYMON038 | g429107 | BLASTN | 871 | 1e−63 | 84 |
| 1661 | 12644 | 700888494H1 | SOYMON024 | g429107 | BLASTN | 662 | 1e−46 | 83 |
| 1662 | 16 | LIB3030-009-Q1-B1-C1 | LIB3030 | g429105 | BLASTN | 1439 | 1e−119 | 84 |
| 1663 | 16 | LIB3051-106-Q1-K1-B5 | LIB3051 | g609224 | BLASTN | 1516 | 1e−117 | 86 |
| 1664 | 16 | LIB3050-023-Q1-K1-A12 | LIB3050 | g1724103 | BLASTN | 1388 | 1e−106 | 83 |
| 1665 | 16 | LIB3028-003-Q1-B1-G11 | LIB3028 | g609224 | BLASTN | 1313 | 1e−100 | 87 |
| 1666 | 16 | LIB3054-010-Q1-N1-E2 | LIB3054 | g609224 | BLASTN | 920 | 1e−95 | 87 |
| 1667 | 16 | 700651294H1 | SOYMON003 | g609224 | BLASTN | 672 | 1e−94 | 86 |
| 1668 | 16 | LIB3027-007-Q1-B1-G3 | LIB3027 | g16508 | BLASTN | 891 | 1e−93 | 83 |
| 1669 | 16 | LIB3053-013-Q1-N1-H9 | LIB3053 | g609224 | BLASTN | 996 | 1e−93 | 87 |
| 1670 | 16 | LIB3051-061-Q1-K1-C7 | LIB3051 | g16508 | BLASTN | 1195 | 1e−93 | 86 |
| 1671 | 16 | LIB3065-005-Q1-N1-A6 | LIB3065 | g609224 | BLASTN | 707 | 1e−91 | 78 |
| 1672 | 16 | LIB3050-008-Q1-E1-E3 | LIB3050 | g609224 | BLASTN | 1102 | 1e−87 | 87 |
| 1673 | 16 | LIB3051-011-Q1-E1-B2 | LIB3051 | g16508 | BLASTN | 1153 | 1e−87 | 82 |
| 1674 | 16 | LIB3030-010-Q1-B1-F8 | LIB3030 | g609224 | BLASTN | 988 | 1e−86 | 83 |
| 1675 | 16 | 700652104H1 | SOYMON003 | g1655577 | BLASTN | 990 | 1e−86 | 83 |
| 1676 | 16 | 701205279H1 | SOYMON035 | g609556 | BLASTN | 1125 | 1e−85 | 86 |
| 1677 | 16 | 700662183H1 | SOYMON005 | g609224 | BLASTN | 678 | 1e−83 | 84 |
| 1678 | 16 | LIB3051-039-Q1-K1-F5 | LIB3051 | g169664 | BLASTN | 1104 | 1e−83 | 86 |
| 1679 | 16 | 700557616H1 | SOYMON001 | g609556 | BLASTN | 1111 | 1e−83 | 86 |
| 1680 | 16 | LIB3030-002-Q1-B1-C6 | LIB3030 | g16508 | BLASTN | 1113 | 1e−83 | 83 |
| 1681 | 16 | 700865235H1 | SOYMON016 | g1724103 | BLASTN | 1090 | 1e−82 | 84 |
| 1682 | 16 | 700563340H1 | SOYMON002 | g609224 | BLASTN | 911 | 1e−80 | 86 |

TABLE A*-continued

METHIONINE ADENOSYLTRANSFERASE (EC 2.5.1.6)

| Seq No. | Cluster ID | CloneID | Library | NCBI gi | Method | Score | P-value | % Ident |
|---|---|---|---|---|---|---|---|---|
| 1683 | 16 | LIB3040-044-Q1-E1-D7 | LIB3040 | g166873 | BLASTN | 1052 | 1e-80 | 82 |
| 1684 | 16 | LIB3040-060-Q1-E1-D9 | LIB3040 | g609224 | BLASTN | 1071 | 1e-80 | 84 |
| 1685 | 16 | LIB3049-001-Q1-E1-F12 | LIB3049 | g16508 | BLASTN | 1074 | 1e-80 | 84 |
| 1686 | 16 | LIB3028-006-Q1-B1-F1 | LIB3028 | g16508 | BLASTN | 857 | 1e-79 | 83 |
| 1687 | 16 | LIB3049-033-Q1-E1-G5 | LIB3049 | g2315139 | BLASTN | 933 | 1e-79 | 81 |
| 1688 | 16 | 700978240H1 | SOYMON009 | g609224 | BLASTN | 984 | 1e-79 | 88 |
| 1689 | 16 | 700980802H1 | SOYMON009 | g862999 | BLASTN | 1060 | 1e-79 | 85 |
| 1690 | 16 | 700755908H1 | SOYMON014 | g1724103 | BLASTN | 1062 | 1e-79 | 88 |
| 1691 | 16 | 700562226H1 | SOYMON002 | g1724103 | BLASTN | 1065 | 1e-79 | 84 |
| 1692 | 16 | 701119101H1 | SOYMON037 | g609224 | BLASTN | 1048 | 1e-78 | 86 |
| 1693 | 16 | 700646291H1 | SOYMON012 | g1655577 | BLASTN | 1049 | 1e-78 | 86 |
| 1694 | 16 | LIB3050-022-Q1-K1-B9 | LIB3050 | g16508 | BLASTN | 1049 | 1e-78 | 83 |
| 1695 | 16 | LIB3028-030-Q1-B1-F8 | LIB3028 | g16508 | BLASTN | 1053 | 1e-78 | 83 |
| 1696 | 16 | 701143128H1 | SOYMON038 | g609556 | BLASTN | 737 | 1e-77 | 86 |
| 1697 | 16 | LIB3040-041-Q1-E1-D10 | LIB3040 | g166873 | BLASTN | 861 | 1e-77 | 81 |
| 1698 | 16 | 700756363H1 | SOYMON014 | g609556 | BLASTN | 1031 | 1e-77 | 88 |
| 1699 | 16 | 700729963H1 | SOYMON009 | g1724103 | BLASTN | 1036 | 1e-77 | 88 |
| 1700 | 16 | 701063046H1 | SOYMON033 | g609224 | BLASTN | 1037 | 1e-77 | 86 |
| 1701 | 16 | LIB3030-005-Q1-B1-G2 | LIB3030 | g609224 | BLASTN | 1038 | 1e-77 | 84 |
| 1702 | 16 | 700564331H1 | SOYMON002 | g609556 | BLASTN | 1039 | 1e-77 | 84 |
| 1703 | 16 | 700562958H1 | SOYMON002 | g1724103 | BLASTN | 1040 | 1e-77 | 88 |
| 1704 | 16 | LIB3039-014-Q1-E1-F7 | LIB3039 | g16508 | BLASTN | 569 | 1e-76 | 84 |
| 1705 | 16 | 700753632H1 | SOYMON014 | g497899 | BLASTN | 668 | 1e-76 | 83 |
| 1706 | 16 | LIB3049-048-Q1-E1-F2 | LIB3049 | g16508 | BLASTN | 722 | 1e-76 | 83 |
| 1707 | 16 | 700648911H1 | SOYMON003 | g1655577 | BLASTN | 983 | 1e-76 | 83 |
| 1708 | 16 | LIB3040-027-Q1-E1-H3 | LIB3040 | g166873 | BLASTN | 1003 | 1e-76 | 81 |
| 1709 | 16 | 700664905H1 | SOYMON005 | g609556 | BLASTN | 1020 | 1e-76 | 86 |
| 1710 | 16 | 701133404H1 | SOYMON038 | g1724103 | BLASTN | 1023 | 1e-76 | 85 |
| 1711 | 16 | 701208780H1 | SOYMON035 | g1655577 | BLASTN | 1025 | 1e-76 | 85 |
| 1712 | 16 | 700902279H1 | SOYMON027 | g169664 | BLASTN | 1026 | 1e-76 | 88 |
| 1713 | 16 | LIB3040-048-Q1-E1-G10 | LIB3040 | g16508 | BLASTN | 1030 | 1e-76 | 83 |
| 1714 | 16 | LIB3040-028-Q1-E1-A4 | LIB3040 | g16508 | BLASTN | 979 | 1e-75 | 84 |
| 1715 | 16 | 700807586H1 | SOYMON016 | g609224 | BLASTN | 1006 | 1e-75 | 86 |
| 1716 | 16 | 700755486H1 | SOYMON014 | g609224 | BLASTN | 1006 | 1e-75 | 87 |
| 1717 | 16 | 700724920H1 | SOYMON009 | g609224 | BLASTN | 1009 | 1e-75 | 87 |
| 1718 | 16 | 701007494H2 | SOYMON019 | g1724103 | BLASTN | 1013 | 1e-75 | 85 |
| 1719 | 16 | 700568310H1 | SOYMON002 | g497899 | BLASTN | 834 | 1e-74 | 83 |
| 1720 | 16 | 701208819H1 | SOYMON035 | g609224 | BLASTN | 857 | 1e-74 | 87 |
| 1721 | 16 | 700985084H1 | SOYMON009 | g609224 | BLASTN | 872 | 1e-74 | 85 |
| 1722 | 16 | 701013074H1 | SOYMON019 | g726031 | BLASTN | 894 | 1e-74 | 88 |
| 1723 | 16 | 700650843H1 | SOYMON003 | g609224 | BLASTN | 924 | 1e-74 | 86 |
| 1724 | 16 | 700646037H1 | SOYMON011 | g609556 | BLASTN | 930 | 1e-74 | 84 |
| 1725 | 16 | LIB3040-039-Q1-E1-H9 | LIB3040 | g166873 | BLASTN | 973 | 1e-74 | 80 |
| 1726 | 16 | 700847231H1 | SOYMON021 | g726031 | BLASTN | 999 | 1e-74 | 85 |
| 1727 | 16 | 700792293H1 | SOYMON011 | g609224 | BLASTN | 999 | 1e-74 | 86 |
| 1728 | 16 | 701109644H1 | SOYMON036 | g609556 | BLASTN | 1004 | 1e-74 | 86 |
| 1729 | 16 | 701122929H1 | SOYMON037 | g1724103 | BLASTN | 459 | 1e-73 | 87 |
| 1730 | 16 | 700661491H1 | SOYMON005 | g16508 | BLASTN | 540 | 1e-73 | 90 |
| 1731 | 16 | 701120070H1 | SOYMON037 | g609224 | BLASTN | 786 | 1e-73 | 87 |
| 1732 | 16 | 700898895H1 | SOYMON027 | g609556 | BLASTN | 820 | 1e-73 | 88 |
| 1733 | 16 | 701096959H1 | SOYMON028 | g429105 | BLASTN | 839 | 1e-73 | 82 |
| 1734 | 16 | 700848356H1 | SOYMON021 | g497899 | BLASTN | 985 | 1e-73 | 85 |
| 1735 | 16 | 700864876H1 | SOYMON016 | g1724103 | BLASTN | 985 | 1e-73 | 88 |
| 1736 | 16 | 700868456H1 | SOYMON016 | g609224 | BLASTN | 987 | 1e-73 | 86 |
| 1737 | 16 | 701210488H1 | SOYMON035 | g1655577 | BLASTN | 988 | 1e-73 | 83 |
| 1738 | 16 | 700747764H1 | SOYMON013 | g609224 | BLASTN | 822 | 1e-72 | 87 |
| 1739 | 16 | 701063311H1 | SOYMON033 | g1655577 | BLASTN | 971 | 1e-72 | 86 |
| 1740 | 16 | 700868625H1 | SOYMON016 | g1724103 | BLASTN | 973 | 1e-72 | 85 |
| 1741 | 16 | 700992344H1 | SOYMON011 | g726031 | BLASTN | 973 | 1e-72 | 85 |
| 1742 | 16 | 701012719H1 | SOYMON019 | g1724103 | BLASTN | 973 | 1e-72 | 85 |
| 1743 | 16 | 700676769H1 | SOYMON007 | g609224 | BLASTN | 973 | 1e-72 | 87 |
| 1744 | 16 | 700946235H1 | SOYMON024 | g609224 | BLASTN | 975 | 1e-72 | 85 |
| 1745 | 16 | 700891218H1 | SOYMON024 | g1724103 | BLASTN | 975 | 1e-72 | 84 |
| 1746 | 16 | 700724907H1 | SOYMON009 | g609556 | BLASTN | 977 | 1e-72 | 84 |
| 1747 | 16 | 700833549H1 | SOYMON019 | g1655577 | BLASTN | 979 | 1e-72 | 85 |
| 1748 | 16 | 700942105H1 | SOYMON024 | g609224 | BLASTN | 980 | 1e-72 | 84 |
| 1749 | 16 | 700564290H1 | SOYMON002 | g726031 | BLASTN | 530 | 1e-71 | 84 |
| 1750 | 16 | 700891233H1 | SOYMON024 | g1724103 | BLASTN | 746 | 1e-71 | 86 |
| 1751 | 16 | LIB3028-025-Q1-B1-B2 | LIB3028 | g609224 | BLASTN | 870 | 1e-71 | 85 |
| 1752 | 16 | 701120896H1 | SOYMON037 | g429105 | BLASTN | 959 | 1e-71 | 82 |
| 1753 | 16 | LIB3051-027-Q1-K1-A9 | LIB3051 | g609224 | BLASTN | 962 | 1e-71 | 83 |
| 1754 | 16 | 701050696H1 | SOYMON032 | g609556 | BLASTN | 965 | 1e-71 | 86 |
| 1755 | 16 | 700653619H1 | SOYMON003 | g609224 | BLASTN | 966 | 1e-71 | 86 |
| 1756 | 16 | 701047994H1 | SOYMON032 | g1724103 | BLASTN | 967 | 1e-71 | 85 |
| 1757 | 16 | 701123056H1 | SOYMON037 | g1724103 | BLASTN | 968 | 1e-71 | 85 |

TABLE A*-continued

METHIONINE ADENOSYLTRANSFERASE (EC 2.5.1.6)

| Seq No. | Cluster ID | CloneID | Library | NCBI gi | Method | Score | P-value | % Ident |
|---|---|---|---|---|---|---|---|---|
| 1758 | 16 | 700983479H1 | SOYMON009 | g726031 | BLASTN | 653 | 1e−70 | 85 |
| 1759 | 16 | 701063733H1 | SOYMON034 | g1655577 | BLASTN | 850 | 1e−70 | 85 |
| 1760 | 16 | 700738366H1 | SOYMON012 | g726031 | BLASTN | 946 | 1e−70 | 85 |
| 1761 | 16 | 700866319H1 | SOYMON016 | g1655575 | BLASTN | 947 | 1e−70 | 85 |
| 1762 | 16 | 700789013H2 | SOYMON011 | g1655577 | BLASTN | 948 | 1e−70 | 85 |
| 1763 | 16 | 700896080H1 | SOYMON027 | g609224 | BLASTN | 949 | 1e−70 | 87 |
| 1764 | 16 | LIB3039-021-Q1-E1-F12 | LIB3039 | g16508 | BLASTN | 950 | 1e−70 | 83 |
| 1765 | 16 | 700898284H1 | SOYMON027 | g429105 | BLASTN | 950 | 1e−70 | 86 |
| 1766 | 16 | 700901743H1 | SOYMON027 | g609224 | BLASTN | 950 | 1e−70 | 86 |
| 1767 | 16 | 700831048H1 | SOYMON019 | g429105 | BLASTN | 951 | 1e−70 | 85 |
| 1768 | 16 | 701038107H1 | SOYMON029 | g726031 | BLASTN | 952 | 1e−70 | 87 |
| 1769 | 16 | 700559703H1 | SOYMON001 | g726031 | BLASTN | 954 | 1e−70 | 88 |
| 1770 | 16 | 700848817H1 | SOYMON021 | g609224 | BLASTN | 954 | 1e−70 | 84 |
| 1771 | 16 | 700896032H1 | SOYMON027 | g609224 | BLASTN | 956 | 1e−70 | 87 |
| 1772 | 16 | 700944764H1 | SOYMON024 | g16508 | BLASTN | 567 | 1e−69 | 85 |
| 1773 | 16 | 701011015H1 | SOYMON019 | g1724103 | BLASTN | 647 | 1e−69 | 81 |
| 1774 | 16 | 701125662H1 | SOYMON037 | g609224 | BLASTN | 751 | 1e−69 | 87 |
| 1775 | 16 | 701046895H1 | SOYMON032 | g16508 | BLASTN | 795 | 1e−69 | 83 |
| 1776 | 16 | 701012632H1 | SOYMON019 | g1655577 | BLASTN | 800 | 1e−69 | 85 |
| 1777 | 16 | 701005244H1 | SOYMON019 | g1724103 | BLASTN | 804 | 1e−69 | 82 |
| 1778 | 16 | LIB3050-023-Q1-K1-H10 | LIB3050 | g609224 | BLASTN | 899 | 1e−69 | 83 |
| 1779 | 16 | 700892558H1 | SOYMON024 | g1655575 | BLASTN | 936 | 1e−69 | 85 |
| 1780 | 16 | 700988779H1 | SOYMON011 | g16508 | BLASTN | 937 | 1e−69 | 82 |
| 1781 | 16 | 701203923H2 | SOYMON035 | g429105 | BLASTN | 938 | 1e−69 | 86 |
| 1782 | 16 | 701010231H2 | SOYMON019 | g1724103 | BLASTN | 938 | 1e−69 | 83 |
| 1783 | 16 | 701041790H1 | SOYMON029 | g450548 | BLASTN | 939 | 1e−69 | 84 |
| 1784 | 16 | 700967887H1 | SOYMON033 | g1724103 | BLASTN | 940 | 1e−69 | 87 |
| 1785 | 16 | 701123361H1 | SOYMON037 | g16508 | BLASTN | 941 | 1e−69 | 84 |
| 1786 | 16 | 701123154H1 | SOYMON037 | g1724103 | BLASTN | 942 | 1e−69 | 86 |
| 1787 | 16 | 701045767H1 | SOYMON032 | g726031 | BLASTN | 942 | 1e−69 | 85 |
| 1788 | 16 | 700983288H1 | SOYMON009 | g609224 | BLASTN | 945 | 1e−69 | 83 |
| 1789 | 16 | 700653053H1 | SOYMON003 | g609224 | BLASTN | 945 | 1e−69 | 86 |
| 1790 | 16 | 701044226H1 | SOYMON032 | g1655577 | BLASTN | 486 | 1e−68 | 83 |
| 1791 | 16 | 700969927H1 | SOYMON005 | g497899 | BLASTN | 750 | 1e−68 | 85 |
| 1792 | 16 | 700547956H1 | SOYMON001 | g609224 | BLASTN | 779 | 1e−68 | 87 |
| 1793 | 16 | LIB3049-048-Q1-E1-E4 | LIB3049 | g609224 | BLASTN | 827 | 1e−68 | 83 |
| 1794 | 16 | 701140780H1 | SOYMON038 | g1655577 | BLASTN | 922 | 1e−68 | 85 |
| 1795 | 16 | 700849166H1 | SOYMON021 | g1724103 | BLASTN | 923 | 1e−68 | 84 |
| 1796 | 16 | 700891945H1 | SOYMON024 | g609556 | BLASTN | 925 | 1e−68 | 87 |
| 1797 | 16 | 700658051H1 | SOYMON004 | g429105 | BLASTN | 925 | 1e−68 | 83 |
| 1798 | 16 | 700942415H1 | SOYMON024 | g1655575 | BLASTN | 928 | 1e−68 | 84 |
| 1799 | 16 | 701041890H1 | SOYMON029 | g1724103 | BLASTN | 930 | 1e−68 | 82 |
| 1800 | 16 | LIB3028-006-Q1-B1-H12 | LIB3028 | g16508 | BLASTN | 931 | 1e−68 | 81 |
| 1801 | 16 | 700967039H1 | SOYMON029 | g429105 | BLASTN | 931 | 1e−68 | 85 |
| 1802 | 16 | 700836178H1 | SOYMON019 | g1724103 | BLASTN | 933 | 1e−68 | 85 |
| 1803 | 16 | 700897558H1 | SOYMON027 | g16508 | BLASTN | 737 | 1e−67 | 85 |
| 1804 | 16 | LIB3050-004-Q1-E1-A2 | LIB3050 | g609224 | BLASTN | 796 | 1e−67 | 80 |
| 1805 | 16 | 700730236H1 | SOYMON009 | g726031 | BLASTN | 816 | 1e−67 | 84 |
| 1806 | 16 | 700833936H1 | SOYMON019 | g1724103 | BLASTN | 915 | 1e−67 | 84 |
| 1807 | 16 | 700897552H1 | SOYMON027 | g1655577 | BLASTN | 916 | 1e−67 | 84 |
| 1808 | 16 | 700945440H1 | SOYMON024 | g609556 | BLASTN | 917 | 1e−67 | 84 |
| 1809 | 16 | 700961368H1 | SOYMON022 | g169664 | BLASTN | 918 | 1e−67 | 88 |
| 1810 | 16 | 700789702H1 | SOYMON011 | g609224 | BLASTN | 921 | 1e−67 | 86 |
| 1811 | 16 | 700786541H1 | SOYMON011 | g429105 | BLASTN | 513 | 1e−66 | 84 |
| 1812 | 16 | 700987282H1 | SOYMON009 | g16508 | BLASTN | 523 | 1e−66 | 87 |
| 1813 | 16 | 700661002H1 | SOYMON005 | g2305013 | BLASTN | 836 | 1e−66 | 81 |
| 1814 | 16 | 701148312H1 | SOYMON031 | g862999 | BLASTN | 899 | 1e−66 | 84 |
| 1815 | 16 | 700738822H1 | SOYMON012 | g1655577 | BLASTN | 899 | 1e−66 | 85 |
| 1816 | 16 | 700940996H1 | SOYMON024 | g609556 | BLASTN | 901 | 1e−66 | 86 |
| 1817 | 16 | 700749195H1 | SOYMON013 | g609556 | BLASTN | 903 | 1e−66 | 81 |
| 1818 | 16 | 700893941H1 | SOYMON024 | g429105 | BLASTN | 903 | 1e−66 | 88 |
| 1819 | 16 | 700892888H1 | SOYMON024 | g609556 | BLASTN | 906 | 1e−66 | 86 |
| 1820 | 16 | 700901481H1 | SOYMON027 | g169664 | BLASTN | 638 | 1e−65 | 86 |
| 1821 | 16 | 700945269H1 | SOYMON024 | g169664 | BLASTN | 688 | 1e−65 | 86 |
| 1822 | 16 | 700746876H1 | SOYMON013 | g609556 | BLASTN | 740 | 1e−65 | 85 |
| 1823 | 16 | 700755043H1 | SOYMON014 | g609556 | BLASTN | 760 | 1e−65 | 87 |
| 1824 | 16 | 701097166H1 | SOYMON028 | g1655577 | BLASTN | 781 | 1e−65 | 82 |
| 1825 | 16 | 701129484H1 | SOYMON037 | g16508 | BLASTN | 898 | 1e−65 | 82 |
| 1826 | 16 | 700651014H1 | SOYMON003 | g167961 | BLASTN | 464 | 1e−64 | 81 |
| 1827 | 16 | 701134363H1 | SOYMON038 | g726031 | BLASTN | 687 | 1e−64 | 84 |
| 1828 | 16 | 701124677H1 | SOYMON037 | g726031 | BLASTN | 876 | 1e−64 | 85 |
| 1829 | 16 | 701000359H1 | SOYMON018 | g1724103 | BLASTN | 877 | 1e−64 | 87 |
| 1830 | 16 | 701139375H1 | SOYMON038 | g1724103 | BLASTN | 883 | 1e−64 | 84 |
| 1831 | 16 | 700832784H1 | SOYMON019 | g609224 | BLASTN | 883 | 1e−64 | 89 |
| 1832 | 16 | 700980227H1 | SOYMON009 | g1724103 | BLASTN | 884 | 1e−64 | 84 |

TABLE A*-continued

METHIONINE ADENOSYLTRANSFERASE (EC 2.5.1.6)

| Seq No. | Cluster ID | CloneID | Library | NCBI gi | Method | Score | P-value | % Ident |
|---|---|---|---|---|---|---|---|---|
| 1833 | 16 | 700943177H1 | SOYMON024 | g1655577 | BLASTN | 885 | 1e−64 | 85 |
| 1834 | 16 | 700844446H1 | SOYMON021 | g2315139 | BLASTN | 355 | 1e−63 | 84 |
| 1835 | 16 | 700836453H1 | SOYMON020 | g862999 | BLASTN | 494 | 1e−63 | 85 |
| 1836 | 16 | 700983012H1 | SOYMON009 | g16508 | BLASTN | 756 | 1e−63 | 83 |
| 1837 | 16 | 700795805H1 | SOYMON017 | g1655577 | BLASTN | 833 | 1e−63 | 85 |
| 1838 | 16 | 701213663H1 | SOYMON035 | g1724103 | BLASTN | 862 | 1e−63 | 84 |
| 1839 | 16 | 700868366H1 | SOYMON016 | g167961 | BLASTN | 864 | 1e−63 | 83 |
| 1840 | 16 | 701134377H1 | SOYMON038 | g2305013 | BLASTN | 865 | 1e−63 | 79 |
| 1841 | 16 | LIB3049-007-Q1-E1-C9 | LIB3049 | g16508 | BLASTN | 867 | 1e−63 | 79 |
| 1842 | 16 | 700944577H1 | SOYMON024 | g862999 | BLASTN | 869 | 1e−63 | 85 |
| 1843 | 16 | 700992289H1 | SOYMON011 | g16508 | BLASTN | 869 | 1e−63 | 84 |
| 1844 | 16 | 700891612H1 | SOYMON024 | g609556 | BLASTN | 872 | 1e−63 | 86 |
| 1845 | 16 | 700738277H1 | SOYMON012 | g609224 | BLASTN | 463 | 1e−62 | 85 |
| 1846 | 16 | 700895571H1 | SOYMON027 | g609224 | BLASTN | 562 | 1e−62 | 88 |
| 1847 | 16 | LIB3049-008-Q1-E1-B3 | LIB3049 | g16508 | BLASTN | 853 | 1e−62 | 77 |
| 1848 | 16 | LIB3027-010-Q1-B1-E12 | LIB3027 | g609224 | BLASTN | 854 | 1e−62 | 82 |
| 1849 | 16 | 701129389H1 | SOYMON037 | g16508 | BLASTN | 854 | 1e−62 | 83 |
| 1850 | 16 | 701045542H1 | SOYMON032 | g429105 | BLASTN | 855 | 1e−62 | 86 |
| 1851 | 16 | 700969901H1 | SOYMON005 | g726031 | BLASTN | 856 | 1e−62 | 84 |
| 1852 | 16 | 700984664H1 | SOYMON009 | g1724103 | BLASTN | 856 | 1e−62 | 81 |
| 1853 | 16 | 700561352H1 | SOYMON002 | g609224 | BLASTN | 858 | 1e−62 | 85 |
| 1854 | 16 | 701138828H1 | SOYMON038 | g16508 | BLASTN | 858 | 1e−62 | 84 |
| 1855 | 16 | 700845962H1 | SOYMON021 | g1655577 | BLASTN | 861 | 1e−62 | 87 |
| 1856 | 16 | 700896147H1 | SOYMON027 | g16508 | BLASTN | 336 | 1e−61 | 82 |
| 1857 | 16 | 701137929H1 | SOYMON038 | g1655577 | BLASTN | 502 | 1e−61 | 84 |
| 1858 | 16 | LIB3040-032-Q1-E1-B8 | LIB3040 | g16508 | BLASTN | 521 | 1e−61 | 82 |
| 1859 | 16 | 701009537H1 | SOYMON019 | g726031 | BLASTN | 545 | 1e−61 | 86 |
| 1860 | 16 | LIB3049-031-Q1-E1-E4 | LIB3049 | g609224 | BLASTN | 677 | 1e−61 | 82 |
| 1861 | 16 | LIB3049-031-Q1-E1-C7 | LIB3049 | g167961 | BLASTN | 696 | 1e−61 | 82 |
| 1862 | 16 | 700891843H1 | SOYMON024 | g1655577 | BLASTN | 737 | 1e−61 | 84 |
| 1863 | 16 | 700561231H1 | SOYMON002 | g16508 | BLASTN | 839 | 1e−61 | 82 |
| 1864 | 16 | 700548238H1 | SOYMON002 | g429105 | BLASTN | 843 | 1e−61 | 85 |
| 1865 | 16 | 700901018H1 | SOYMON027 | g2305013 | BLASTN | 845 | 1e−61 | 82 |
| 1866 | 16 | 701134413H1 | SOYMON038 | g2305013 | BLASTN | 848 | 1e−61 | 82 |
| 1867 | 16 | 700653524H1 | SOYMON003 | g609224 | BLASTN | 499 | 1e−60 | 85 |
| 1868 | 16 | LIB3049-017-Q1-E1-G8 | LIB3049 | g16508 | BLASTN | 514 | 1e−60 | 82 |
| 1869 | 16 | 701121077H1 | SOYMON037 | g16508 | BLASTN | 671 | 1e−60 | 84 |
| 1870 | 16 | LIB3056-013-Q1-N1-A9 | LIB3056 | g609224 | BLASTN | 784 | 1e−60 | 86 |
| 1871 | 16 | 700943524H1 | SOYMON024 | g16508 | BLASTN | 831 | 1e−60 | 85 |
| 1872 | 16 | 700952889H1 | SOYMON022 | g429103 | BLASTN | 835 | 1e−60 | 84 |
| 1873 | 16 | 700730632H1 | SOYMON009 | g1655577 | BLASTN | 431 | 1e−59 | 82 |
| 1874 | 16 | 700649136H1 | SOYMON003 | g609224 | BLASTN | 486 | 1e−59 | 84 |
| 1875 | 16 | 700895591H1 | SOYMON027 | g609556 | BLASTN | 492 | 1e−59 | 87 |
| 1876 | 16 | 701009829H1 | SOYMON019 | g429103 | BLASTN | 572 | 1e−59 | 80 |
| 1877 | 16 | LIB3039-011-Q1-E1-C11 | LIB3039 | g16508 | BLASTN | 619 | 1e−59 | 83 |
| 1878 | 16 | LIB3040-055-Q1-E1-C4 | LIB3040 | g16508 | BLASTN | 622 | 1e−59 | 82 |
| 1879 | 16 | 701123571H1 | SOYMON037 | g2305013 | BLASTN | 682 | 1e−59 | 81 |
| 1880 | 16 | LIB3049-004-Q1-E1-E5 | LIB3049 | g167961 | BLASTN | 771 | 1e−59 | 83 |
| 1881 | 16 | 701002239H1 | SOYMON018 | g609224 | BLASTN | 782 | 1e−59 | 86 |
| 1882 | 16 | 700971088H1 | SOYMON005 | g1724103 | BLASTN | 793 | 1e−59 | 81 |
| 1883 | 16 | 700864624H1 | SOYMON016 | g167961 | BLASTN | 817 | 1e−59 | 83 |
| 1884 | 16 | 700863534H1 | SOYMON027 | g16508 | BLASTN | 818 | 1e−59 | 86 |
| 1885 | 16 | 700749489H1 | SOYMON013 | g16508 | BLASTN | 823 | 1e−59 | 86 |
| 1886 | 16 | 700730689H1 | SOYMON009 | g16508 | BLASTN | 825 | 1e−59 | 83 |
| 1887 | 16 | LIB3049-050-Q1-E1-A11 | LIB3049 | g16508 | BLASTN | 831 | 1e−59 | 83 |
| 1888 | 16 | 700850803H1 | SOYMON023 | g1655577 | BLASTN | 511 | 1e−58 | 83 |
| 1889 | 16 | 700992317H1 | SOYMON011 | g1655577 | BLASTN | 520 | 1e−58 | 79 |
| 1890 | 16 | 701119129H1 | SOYMON037 | g16508 | BLASTN | 553 | 1e−58 | 83 |
| 1891 | 16 | 700657623H1 | SOYMON004 | g1724103 | BLASTN | 600 | 1e−58 | 83 |
| 1892 | 16 | LIB3049-015-Q1-E1-F8 | LIB3049 | g16508 | BLASTN | 674 | 1e−58 | 79 |
| 1893 | 16 | 701007027H1 | SOYMON019 | g16508 | BLASTN | 804 | 1e−58 | 81 |
| 1894 | 16 | 701120820H1 | SOYMON037 | g609224 | BLASTN | 807 | 1e−58 | 85 |
| 1895 | 16 | 700654317H1 | SOYMON004 | g1655577 | BLASTN | 811 | 1e−58 | 84 |
| 1896 | 16 | 700889071H1 | SOYMON024 | g497899 | BLASTN | 812 | 1e−58 | 83 |
| 1897 | 16 | 701010676H1 | SOYMON019 | g609224 | BLASTN | 813 | 1e−58 | 85 |
| 1898 | 16 | 701099590H1 | SOYMON028 | g1655577 | BLASTN | 486 | 1e−57 | 82 |
| 1899 | 16 | 700649684H1 | SOYMON003 | g16508 | BLASTN | 540 | 1e−57 | 82 |
| 1900 | 16 | 700994107H1 | SOYMON011 | g16508 | BLASTN | 567 | 1e−57 | 80 |
| 1901 | 16 | 700898629H1 | SOYMON027 | g16508 | BLASTN | 687 | 1e−57 | 82 |
| 1902 | 16 | 700902333H1 | SOYMON027 | g609224 | BLASTN | 700 | 1e−57 | 82 |
| 1903 | 16 | LIB3039-017-Q1-E1-D9 | LIB3039 | g16508 | BLASTN | 703 | 1e−57 | 81 |
| 1904 | 16 | LIB3040-026-Q1-E1-A4 | LIB3040 | g16508 | BLASTN | 709 | 1e−57 | 83 |
| 1905 | 16 | 701130101H1 | SOYMON037 | g1724103 | BLASTN | 791 | 1e−57 | 88 |
| 1906 | 16 | 700902482H1 | SOYMON027 | g169664 | BLASTN | 797 | 1e−57 | 81 |
| 1907 | 16 | 700730789H1 | SOYMON009 | g16508 | BLASTN | 798 | 1e−57 | 82 |

TABLE A*-continued

METHIONINE ADENOSYLTRANSFERASE (EC 2.5.1.6)

| Seq No. | Cluster ID | CloneID | Library | NCBI gi | Method | Score | P-value | % Ident |
|---|---|---|---|---|---|---|---|---|
| 1908 | 16 | 700868670H1 | SOYMON016 | g16508 | BLASTN | 800 | 1e-57 | 83 |
| 1909 | 16 | LIB3029-011-Q1-B1-D1 | LIB3029 | g609224 | BLASTN | 800 | 1e-57 | 82 |
| 1910 | 16 | 701119278H1 | SOYMON037 | g609224 | BLASTN | 801 | 1e-57 | 83 |
| 1911 | 16 | 700747731H1 | SOYMON013 | g16508 | BLASTN | 801 | 1e-57 | 86 |
| 1912 | 16 | LIB3049-017-Q1-E1-A11 | LIB3049 | g16508 | BLASTN | 811 | 1e-57 | 80 |
| 1913 | 16 | 700890428H1 | SOYMON024 | g609224 | BLASTN | 482 | 1e-56 | 83 |
| 1914 | 16 | 700562326H1 | SOYMON002 | g609224 | BLASTN | 778 | 1e-56 | 82 |
| 1915 | 16 | 700567740H1 | SOYMON002 | g609224 | BLASTN | 781 | 1e-56 | 85 |
| 1916 | 16 | 701061514H1 | SOYMON033 | g1724103 | BLASTN | 784 | 1e-56 | 86 |
| 1917 | 16 | 701135670H1 | SOYMON038 | g429105 | BLASTN | 785 | 1e-56 | 81 |
| 1918 | 16 | 701139657H1 | SOYMON038 | g609224 | BLASTN | 786 | 1e-56 | 85 |
| 1919 | 16 | 701123371H1 | SOYMON037 | g16508 | BLASTN | 788 | 1e-56 | 86 |
| 1920 | 16 | 700838744H1 | SOYMON020 | g16508 | BLASTN | 789 | 1e-56 | 82 |
| 1921 | 16 | 701070458H1 | SOYMON034 | g1655577 | BLASTN | 457 | 1e-55 | 78 |
| 1922 | 16 | 701003437H1 | SOYMON019 | g429105 | BLASTN | 474 | 1e-55 | 83 |
| 1923 | 16 | 700835976H1 | SOYMON019 | g16508 | BLASTN | 562 | 1e-55 | 84 |
| 1924 | 16 | 700894535H1 | SOYMON024 | g16508 | BLASTN | 570 | 1e-55 | 86 |
| 1925 | 16 | 700752755H1 | SOYMON014 | g1655577 | BLASTN | 690 | 1e-55 | 83 |
| 1926 | 16 | LIB3049-032-Q1-E1-C9 | LIB3049 | g16508 | BLASTN | 700 | 1e-55 | 83 |
| 1927 | 16 | LIB3040-030-Q1-E1-B5 | LIB3040 | g16508 | BLASTN | 709 | 1e-55 | 84 |
| 1928 | 16 | 701136935H1 | SOYMON038 | g609224 | BLASTN | 766 | 1e-55 | 85 |
| 1929 | 16 | 700682088H1 | SOYMON008 | g169664 | BLASTN | 767 | 1e-55 | 90 |
| 1930 | 16 | 700682188H1 | SOYMON008 | g169664 | BLASTN | 767 | 1e-55 | 90 |
| 1931 | 16 | 701068649H1 | SOYMON034 | g16508 | BLASTN | 770 | 1e-55 | 83 |
| 1932 | 16 | 700726623H1 | SOYMON009 | g16508 | BLASTN | 771 | 1e-55 | 85 |
| 1933 | 16 | 700751129H1 | SOYMON014 | g16508 | BLASTN | 772 | 1e-55 | 86 |
| 1934 | 16 | 700945234H1 | SOYMON024 | g16508 | BLASTN | 773 | 1e-55 | 83 |
| 1935 | 16 | 701133507H2 | SOYMON038 | g609224 | BLASTN | 776 | 1e-55 | 85 |
| 1936 | 16 | 700902459H1 | SOYMON027 | g726031 | BLASTN | 777 | 1e-55 | 84 |
| 1937 | 16 | 700986624H1 | SOYMON009 | g16508 | BLASTN | 612 | 1e-54 | 83 |
| 1938 | 16 | 701097020H1 | SOYMON028 | g609224 | BLASTN | 615 | 1e-54 | 84 |
| 1939 | 16 | 701131409H1 | SOYMON038 | g16508 | BLASTN | 755 | 1e-54 | 91 |
| 1940 | 16 | 700750123H1 | SOYMON013 | g726031 | BLASTN | 756 | 1e-54 | 86 |
| 1941 | 16 | 701040251H1 | SOYMON029 | g16508 | BLASTN | 756 | 1e-54 | 85 |
| 1942 | 16 | 700732290H1 | SOYMON010 | g169664 | BLASTN | 758 | 1e-54 | 90 |
| 1943 | 16 | 701117458H1 | SOYMON037 | g609224 | BLASTN | 759 | 1e-54 | 82 |
| 1944 | 16 | 701118709H1 | SOYMON037 | g16508 | BLASTN | 760 | 1e-54 | 91 |
| 1945 | 16 | 701012834H1 | SOYMON019 | g16508 | BLASTN | 760 | 1e-54 | 91 |
| 1946 | 16 | 701133316H1 | SOYMON038 | g16508 | BLASTN | 760 | 1e-54 | 91 |
| 1947 | 16 | 701129646H1 | SOYMON037 | g16508 | BLASTN | 760 | 1e-54 | 91 |
| 1948 | 16 | 700732265H1 | SOYMON010 | g169664 | BLASTN | 760 | 1e-54 | 90 |
| 1949 | 16 | 701040796H1 | SOYMON029 | g1724103 | BLASTN | 760 | 1e-54 | 89 |
| 1950 | 16 | 700846350H1 | SOYMON021 | g16508 | BLASTN | 761 | 1e-54 | 86 |
| 1951 | 16 | 701137005H1 | SOYMON038 | g16508 | BLASTN | 761 | 1e-54 | 86 |
| 1952 | 16 | 701046506H1 | SOYMON032 | g16508 | BLASTN | 761 | 1e-54 | 91 |
| 1953 | 16 | 700894462H1 | SOYMON024 | g16508 | BLASTN | 761 | 1e-54 | 86 |
| 1954 | 16 | 700973847H1 | SOYMON005 | g16508 | BLASTN | 766 | 1e-54 | 87 |
| 1955 | 16 | 701128215H1 | SOYMON037 | g609556 | BLASTN | 466 | 1e-53 | 82 |
| 1956 | 16 | 700842468H1 | SOYMON020 | g429105 | BLASTN | 548 | 1e-53 | 86 |
| 1957 | 16 | 701051552H1 | SOYMON032 | g609224 | BLASTN | 744 | 1e-53 | 85 |
| 1958 | 16 | 700944049H1 | SOYMON024 | g609224 | BLASTN | 744 | 1e-53 | 85 |
| 1959 | 16 | 701120261H1 | SOYMON037 | g609224 | BLASTN | 746 | 1e-53 | 84 |
| 1960 | 16 | 700897524H1 | SOYMON027 | g609224 | BLASTN | 751 | 1e-53 | 84 |
| 1961 | 16 | LIB3049-042-Q1-E1-F7 | LIB3049 | g450548 | BLASTN | 761 | 1e-53 | 75 |
| 1962 | 16 | 700896909H1 | SOYMON027 | g429105 | BLASTN | 536 | 1e-52 | 82 |
| 1963 | 16 | 700974820H1 | SOYMON005 | g1724103 | BLASTN | 582 | 1e-52 | 86 |
| 1964 | 16 | 701143224H1 | SOYMON038 | g609224 | BLASTN | 731 | 1e-52 | 84 |
| 1965 | 16 | 701010322H1 | SOYMON019 | g609224 | BLASTN | 731 | 1e-52 | 85 |
| 1966 | 16 | 701130510H1 | SOYMON038 | g609224 | BLASTN | 732 | 1e-52 | 83 |
| 1967 | 16 | 700724904H1 | SOYMON009 | g609224 | BLASTN | 733 | 1e-52 | 85 |
| 1968 | 16 | 701119845H1 | SOYMON037 | g609224 | BLASTN | 734 | 1e-52 | 85 |
| 1969 | 16 | 701107871H1 | SOYMON036 | g16508 | BLASTN | 737 | 1e-52 | 86 |
| 1970 | 16 | 700983380H1 | SOYMON009 | g609224 | BLASTN | 738 | 1e-52 | 84 |
| 1971 | 16 | 700896469H1 | SOYMON027 | g16508 | BLASTN | 741 | 1e-52 | 86 |
| 1972 | 16 | 700792178H1 | SOYMON011 | g16508 | BLASTN | 742 | 1e-52 | 85 |
| 1973 | 16 | 701099906H1 | SOYMON028 | g16508 | BLASTN | 431 | 1e-51 | 89 |
| 1974 | 16 | 701134724H2 | SOYMON038 | g16508 | BLASTN | 553 | 1e-51 | 85 |
| 1975 | 16 | 700749712H1 | SOYMON013 | g16508 | BLASTN | 689 | 1e-51 | 87 |
| 1976 | 16 | 700982567H1 | SOYMON009 | g609224 | BLASTN | 723 | 1e-51 | 85 |
| 1977 | 16 | 701013758H1 | SOYMON019 | g609224 | BLASTN | 723 | 1e-51 | 85 |
| 1978 | 16 | 700868508H1 | SOYMON016 | g609224 | BLASTN | 723 | 1e-51 | 85 |
| 1979 | 16 | 700749316H1 | SOYMON013 | g609224 | BLASTN | 723 | 1e-51 | 85 |
| 1980 | 16 | 701045367H1 | SOYMON032 | g16508 | BLASTN | 724 | 1e-51 | 91 |
| 1981 | 16 | 701205494H1 | SOYMON035 | g609224 | BLASTN | 724 | 1e-51 | 84 |
| 1982 | 16 | 700556784H1 | SOYMON001 | g16508 | BLASTN | 724 | 1e-51 | 91 |

TABLE A*-continued

METHIONINE ADENOSYLTRANSFERASE (EC 2.5.1.6)

| Seq No. | Cluster ID | CloneID | Library | NCBI gi | Method | Score | P-value | % Ident |
|---|---|---|---|---|---|---|---|---|
| 1983 | 16 | 701099879H1 | SOYMON028 | g16508 | BLASTN | 726 | 1e-51 | 80 |
| 1984 | 16 | 701131671H1 | SOYMON038 | g609224 | BLASTN | 728 | 1e-51 | 85 |
| 1985 | 16 | 701011505H1 | SOYMON019 | g609224 | BLASTN | 728 | 1e-51 | 85 |
| 1986 | 16 | 701009973H2 | SOYMON019 | g609224 | BLASTN | 728 | 1e-51 | 85 |
| 1987 | 16 | 700793520H1 | SOYMON017 | g609224 | BLASTN | 728 | 1e-51 | 85 |
| 1988 | 16 | 700753622H1 | SOYMON014 | g609224 | BLASTN | 728 | 1e-51 | 85 |
| 1989 | 16 | 700984052H1 | SOYMON009 | g609224 | BLASTN | 728 | 1e-51 | 83 |
| 1990 | 16 | 701108521H1 | SOYMON036 | g609224 | BLASTN | 728 | 1e-51 | 85 |
| 1991 | 16 | 700957203H1 | SOYMON022 | g1724103 | BLASTN | 464 | 1e-50 | 86 |
| 1992 | 16 | 700554120H1 | SOYMON001 | g609224 | BLASTN | 528 | 1e-50 | 84 |
| 1993 | 16 | 700555954H1 | SOYMON001 | g167961 | BLASTN | 528 | 1e-50 | 86 |
| 1994 | 16 | 701124141H1 | SOYMON037 | g609224 | BLASTN | 537 | 1e-50 | 85 |
| 1995 | 16 | 701003232H1 | SOYMON019 | g16508 | BLASTN | 544 | 1e-50 | 88 |
| 1996 | 16 | 700653112H1 | SOYMON003 | g16508 | BLASTN | 559 | 1e-50 | 91 |
| 1997 | 16 | 701103353H1 | SOYMON028 | g1655577 | BLASTN | 581 | 1e-50 | 84 |
| 1998 | 16 | 700562790H1 | SOYMON002 | g497899 | BLASTN | 708 | 1e-50 | 86 |
| 1999 | 16 | 701097303H1 | SOYMON028 | g609224 | BLASTN | 711 | 1e-50 | 84 |
| 2000 | 16 | 700561195H1 | SOYMON002 | g609224 | BLASTN | 712 | 1e-50 | 84 |
| 2001 | 16 | 701121162H1 | SOYMON037 | g16508 | BLASTN | 712 | 1e-50 | 88 |
| 2002 | 16 | 700981317H1 | SOYMON009 | g16508 | BLASTN | 714 | 1e-50 | 89 |
| 2003 | 16 | 700981595H1 | SOYMON009 | g16508 | BLASTN | 716 | 1e-50 | 86 |
| 2004 | 16 | 700994305H1 | SOYMON011 | g609224 | BLASTN | 528 | 1e-49 | 85 |
| 2005 | 16 | 701101565H1 | SOYMON028 | g429105 | BLASTN | 552 | 1e-49 | 82 |
| 2006 | 16 | 701103456H1 | SOYMON028 | g429105 | BLASTN | 617 | 1e-49 | 81 |
| 2007 | 16 | 700993331H1 | SOYMON011 | g16508 | BLASTN | 622 | 1e-49 | 86 |
| 2008 | 16 | LIB3052-011-Q1-N1-B12 | LIB3052 | g16508 | BLASTN | 695 | 1e-49 | 85 |
| 2009 | 16 | 701140613H1 | SOYMON038 | g609224 | BLASTN | 697 | 1e-49 | 85 |
| 2010 | 16 | 700745426H1 | SOYMON013 | g16508 | BLASTN | 697 | 1e-49 | 84 |
| 2011 | 16 | 701046530H1 | SOYMON032 | g609224 | BLASTN | 697 | 1e-49 | 84 |
| 2012 | 16 | 701003787H1 | SOYMON019 | g609224 | BLASTN | 697 | 1e-49 | 85 |
| 2013 | 16 | 700840830H1 | SOYMON020 | g1724103 | BLASTN | 699 | 1e-49 | 79 |
| 2014 | 16 | 700901588H1 | SOYMON027 | g609224 | BLASTN | 702 | 1e-49 | 85 |
| 2015 | 16 | 701037824H1 | SOYMON029 | g497899 | BLASTN | 702 | 1e-49 | 87 |
| 2016 | 16 | 701131888H1 | SOYMON038 | g609224 | BLASTN | 702 | 1e-49 | 85 |
| 2017 | 16 | 701009947H2 | SOYMON019 | g609224 | BLASTN | 702 | 1e-49 | 85 |
| 2018 | 16 | 700729216H1 | SOYMON009 | g497899 | BLASTN | 702 | 1e-49 | 87 |
| 2019 | 16 | 700831705H1 | SOYMON019 | g609224 | BLASTN | 702 | 1e-49 | 85 |
| 2020 | 16 | 700900329H1 | SOYMON027 | g429105 | BLASTN | 705 | 1e-49 | 88 |
| 2021 | 16 | 700563946H1 | SOYMON002 | g16508 | BLASTN | 705 | 1e-49 | 83 |
| 2022 | 16 | 700808370H1 | SOYMON024 | g609556 | BLASTN | 459 | 1e-48 | 83 |
| 2023 | 16 | LIB3040-001-Q1-E1-H4 | LIB3040 | g1724103 | BLASTN | 475 | 1e-48 | 76 |
| 2024 | 16 | 700989482H1 | SOYMON011 | g16508 | BLASTN | 498 | 1e-48 | 86 |
| 2025 | 16 | 701001311H1 | SOYMON018 | g16508 | BLASTN | 655 | 1e-48 | 85 |
| 2026 | 16 | 700734733H1 | SOYMON010 | g497899 | BLASTN | 682 | 1e-48 | 87 |
| 2027 | 16 | 701013070H1 | SOYMON019 | g497899 | BLASTN | 682 | 1e-48 | 87 |
| 2028 | 16 | 701120989H1 | SOYMON037 | g16508 | BLASTN | 683 | 1e-48 | 91 |
| 2029 | 16 | LIB3049-025-Q1-E1-B4 | LIB3049 | g167961 | BLASTN | 687 | 1e-48 | 82 |
| 2030 | 16 | 700808455H1 | SOYMON024 | g16508 | BLASTN | 688 | 1e-48 | 87 |
| 2031 | 16 | 701101319H1 | SOYMON028 | g16508 | BLASTN | 688 | 1e-48 | 91 |
| 2032 | 16 | 701037087H1 | SOYMON029 | g609224 | BLASTN | 689 | 1e-48 | 85 |
| 2033 | 16 | 701205225H1 | SOYMON035 | g16508 | BLASTN | 689 | 1e-48 | 84 |
| 2034 | 16 | 701136807H1 | SOYMON038 | g609224 | BLASTN | 690 | 1e-48 | 85 |
| 2035 | 16 | 701118459H1 | SOYMON037 | g609224 | BLASTN | 690 | 1e-48 | 85 |
| 2036 | 16 | 700942825H1 | SOYMON024 | g16508 | BLASTN | 691 | 1e-48 | 85 |
| 2037 | 16 | 701139796H1 | SOYMON038 | g497899 | BLASTN | 692 | 1e-48 | 87 |
| 2038 | 16 | 700557040H1 | SOYMON001 | g609224 | BLASTN | 692 | 1e-48 | 85 |
| 2039 | 16 | 701015715H1 | SOYMON038 | g497899 | BLASTN | 692 | 1e-48 | 87 |
| 2040 | 16 | 700726424H1 | SOYMON009 | g497899 | BLASTN | 693 | 1e-48 | 87 |
| 2041 | 16 | 700790811H1 | SOYMON011 | g497899 | BLASTN | 693 | 1e-48 | 87 |
| 2042 | 16 | LIB3040-038-Q1-E1-E5 | LIB3040 | g16508 | BLASTN | 709 | 1e-48 | 85 |
| 2043 | 16 | 700896626H1 | SOYMON027 | g429107 | BLASTN | 430 | 1e-47 | 84 |
| 2044 | 16 | 700562158H1 | SOYMON002 | g609224 | BLASTN | 518 | 1e-47 | 84 |
| 2045 | 16 | 700747095H1 | SOYMON013 | g16508 | BLASTN | 538 | 1e-47 | 87 |
| 2046 | 16 | 700726532H1 | SOYMON009 | g609224 | BLASTN | 622 | 1e-47 | 85 |
| 2047 | 16 | 701137686H1 | SOYMON038 | g497899 | BLASTN | 671 | 1e-47 | 85 |
| 2048 | 16 | 701009148H1 | SOYMON019 | g16508 | BLASTN | 673 | 1e-47 | 91 |
| 2049 | 16 | 701048279H1 | SOYMON032 | g16508 | BLASTN | 674 | 1e-47 | 86 |
| 2050 | 16 | 701120185H1 | SOYMON037 | g16508 | BLASTN | 674 | 1e-47 | 91 |
| 2051 | 16 | 701040355H1 | SOYMON029 | g497899 | BLASTN | 675 | 1e-47 | 86 |
| 2052 | 16 | 701130203H1 | SOYMON037 | g609224 | BLASTN | 678 | 1e-47 | 83 |
| 2053 | 16 | 701015794H1 | SOYMON038 | g16508 | BLASTN | 681 | 1e-47 | 91 |
| 2054 | 16 | 700732181H1 | SOYMON010 | g16508 | BLASTN | 681 | 1e-47 | 86 |
| 2055 | 16 | LIB3050-018-Q1-E1-D10 | LIB3050 | g2305013 | BLASTN | 696 | 1e-47 | 81 |
| 2056 | 16 | 700899157H1 | SOYMON027 | g609224 | BLASTN | 486 | 1e-46 | 84 |
| 2057 | 16 | 701119905H1 | SOYMON037 | g497899 | BLASTN | 507 | 1e-46 | 86 |

TABLE A*-continued

METHIONINE ADENOSYLTRANSFERASE (EC 2.5.1.6)

| Seq No. | Cluster ID | CloneID | Library | NCBI gi | Method | Score | P-value | % Ident |
|---|---|---|---|---|---|---|---|---|
| 2058 | 16 | 701062873H1 | SOYMON033 | g497899 | BLASTN | 509 | 1e-46 | 88 |
| 2059 | 16 | 701210886H1 | SOYMON035 | g16508 | BLASTN | 540 | 1e-46 | 84 |
| 2060 | 16 | 700893278H1 | SOYMON024 | g16508 | BLASTN | 542 | 1e-46 | 77 |
| 2061 | 16 | 701036970H1 | SOYMON029 | g16508 | BLASTN | 579 | 1e-46 | 88 |
| 2062 | 16 | 700901932H1 | SOYMON027 | g609224 | BLASTN | 640 | 1e-46 | 85 |
| 2063 | 16 | 701044214H1 | SOYMON032 | g429105 | BLASTN | 658 | 1e-46 | 85 |
| 2064 | 16 | 701056917H1 | SOYMON033 | g16508 | BLASTN | 661 | 1e-46 | 85 |
| 2065 | 16 | 700981560H1 | SOYMON009 | g497899 | BLASTN | 661 | 1e-46 | 87 |
| 2066 | 16 | 701213107H1 | SOYMON035 | g609224 | BLASTN | 661 | 1e-46 | 83 |
| 2067 | 16 | 700834235H1 | SOYMON019 | g497899 | BLASTN | 661 | 1e-46 | 87 |
| 2068 | 16 | 700749413H1 | SOYMON013 | g16508 | BLASTN | 662 | 1e-46 | 85 |
| 2069 | 16 | 700889148H1 | SOYMON024 | g16508 | BLASTN | 662 | 1e-46 | 85 |
| 2070 | 16 | 700745009H1 | SOYMON013 | g609224 | BLASTN | 662 | 1e-46 | 85 |
| 2071 | 16 | 701206618H1 | SOYMON035 | g16508 | BLASTN | 663 | 1e-46 | 91 |
| 2072 | 16 | 701131927H1 | SOYMON038 | g497899 | BLASTN | 666 | 1e-46 | 87 |
| 2073 | 16 | 701119069H1 | SOYMON037 | g497899 | BLASTN | 666 | 1e-46 | 87 |
| 2074 | 16 | 701106908H1 | SOYMON036 | g497899 | BLASTN | 666 | 1e-46 | 87 |
| 2075 | 16 | 701103063H1 | SOYMON028 | g497899 | BLASTN | 666 | 1e-46 | 87 |
| 2076 | 16 | 700686659H1 | SOYMON008 | g166873 | BLASTN | 667 | 1e-46 | 86 |
| 2077 | 16 | 701040620H1 | SOYMON029 | g16508 | BLASTN | 669 | 1e-46 | 86 |
| 2078 | 16 | 701012134H1 | SOYMON019 | g497899 | BLASTN | 669 | 1e-46 | 85 |
| 2079 | 16 | 700957508H1 | SOYMON022 | g1724103 | BLASTN | 669 | 1e-46 | 82 |
| 2080 | 16 | 701008548H1 | SOYMON019 | g497899 | BLASTN | 500 | 1e-45 | 87 |
| 2081 | 16 | 700978303H1 | SOYMON009 | g497899 | BLASTN | 506 | 1e-45 | 87 |
| 2082 | 16 | 701119990H1 | SOYMON037 | g497899 | BLASTN | 512 | 1e-45 | 87 |
| 2083 | 16 | 700646222H1 | SOYMON012 | g16508 | BLASTN | 526 | 1e-45 | 85 |
| 2084 | 16 | 701040631H1 | SOYMON029 | g609556 | BLASTN | 542 | 1e-45 | 87 |
| 2085 | 16 | 700894009H1 | SOYMON024 | g497899 | BLASTN | 646 | 1e-45 | 87 |
| 2086 | 16 | 700908702H1 | SOYMON022 | g609224 | BLASTN | 646 | 1e-45 | 85 |
| 2087 | 16 | 700838642H1 | SOYMON020 | g609224 | BLASTN | 646 | 1e-45 | 85 |
| 2088 | 16 | 700832089H1 | SOYMON019 | g609224 | BLASTN | 646 | 1e-45 | 85 |
| 2089 | 16 | 700978279H1 | SOYMON009 | g609224 | BLASTN | 647 | 1e-45 | 80 |
| 2090 | 16 | 700555058H1 | SOYMON001 | g16508 | BLASTN | 649 | 1e-45 | 84 |
| 2091 | 16 | 700906478H1 | SOYMON022 | g497899 | BLASTN | 651 | 1e-45 | 87 |
| 2092 | 16 | 700897237H1 | SOYMON027 | g16508 | BLASTN | 653 | 1e-45 | 86 |
| 2093 | 16 | 701125786H1 | SOYMON037 | g16508 | BLASTN | 654 | 1e-45 | 84 |
| 2094 | 16 | 700562836H1 | SOYMON002 | g16508 | BLASTN | 655 | 1e-45 | 84 |
| 2095 | 16 | 700665969H1 | SOYMON005 | g497899 | BLASTN | 656 | 1e-45 | 87 |
| 2096 | 16 | 701009838H1 | SOYMON019 | g497899 | BLASTN | 656 | 1e-45 | 87 |
| 2097 | 16 | 701211770H1 | SOYMON035 | g16508 | BLASTN | 657 | 1e-45 | 84 |
| 2098 | 16 | 700654550H1 | SOYMON004 | g16508 | BLASTN | 657 | 1e-45 | 83 |
| 2099 | 16 | 700567949H1 | SOYMON002 | g16508 | BLASTN | 657 | 1e-45 | 84 |
| 2100 | 16 | 701048175H1 | SOYMON032 | g16508 | BLASTN | 658 | 1e-45 | 91 |
| 2101 | 16 | 700901037H1 | SOYMON027 | g16508 | BLASTN | 658 | 1e-45 | 86 |
| 2102 | 16 | 700656917H1 | SOYMON004 | g1724103 | BLASTN | 407 | 1e-44 | 81 |
| 2103 | 16 | 700565684H1 | SOYMON002 | g16508 | BLASTN | 463 | 1e-44 | 86 |
| 2104 | 16 | 701002808H1 | SOYMON019 | g497899 | BLASTN | 503 | 1e-44 | 87 |
| 2105 | 16 | 701107115H1 | SOYMON036 | g497899 | BLASTN | 507 | 1e-44 | 87 |
| 2106 | 16 | 701122669H1 | SOYMON037 | g16508 | BLASTN | 636 | 1e-44 | 82 |
| 2107 | 16 | 700894409H1 | SOYMON024 | g497899 | BLASTN | 636 | 1e-44 | 87 |
| 2108 | 16 | 700848374H1 | SOYMON021 | g497899 | BLASTN | 636 | 1e-44 | 87 |
| 2109 | 16 | 700902420H1 | SOYMON027 | g497899 | BLASTN | 636 | 1e-44 | 87 |
| 2110 | 16 | 700747450H1 | SOYMON013 | g16508 | BLASTN | 638 | 1e-44 | 91 |
| 2111 | 16 | 701125869H1 | SOYMON037 | g16508 | BLASTN | 638 | 1e-44 | 91 |
| 2112 | 16 | 700731302H1 | SOYMON010 | g16508 | BLASTN | 639 | 1e-44 | 85 |
| 2113 | 16 | 701099068H1 | SOYMON028 | g2305013 | BLASTN | 640 | 1e-44 | 81 |
| 2114 | 16 | 700975556H1 | SOYMON009 | g450548 | BLASTN | 641 | 1e-44 | 84 |
| 2115 | 16 | 700889660H1 | SOYMON024 | g16508 | BLASTN | 642 | 1e-44 | 86 |
| 2116 | 16 | 700951744H1 | SOYMON022 | g16508 | BLASTN | 642 | 1e-44 | 86 |
| 2117 | 16 | 700750251H1 | SOYMON013 | g609224 | BLASTN | 643 | 1e-44 | 86 |
| 2118 | 16 | 700834611H1 | SOYMON019 | g16508 | BLASTN | 643 | 1e-44 | 91 |
| 2119 | 16 | 700565356H1 | SOYMON002 | g16508 | BLASTN | 643 | 1e-44 | 80 |
| 2120 | 16 | 700673803H1 | SOYMON007 | g16508 | BLASTN | 644 | 1e-44 | 84 |
| 2121 | 16 | 700958721H1 | SOYMON022 | g16508 | BLASTN | 645 | 1e-44 | 86 |
| 2122 | 16 | 700985717H1 | SOYMON009 | g16508 | BLASTN | 646 | 1e-44 | 82 |
| 2123 | 16 | LIB3049-032-Q1-E1-A5 | LIB3049 | g16508 | BLASTN | 662 | 1e-44 | 76 |
| 2124 | 16 | 700733454H1 | SOYMON010 | g609224 | BLASTN | 432 | 1e-43 | 85 |
| 2125 | 16 | 700987656H1 | SOYMON009 | g497899 | BLASTN | 476 | 1e-43 | 87 |
| 2126 | 16 | 700755957H1 | SOYMON014 | g497899 | BLASTN | 483 | 1e-43 | 86 |
| 2127 | 16 | 700749331H1 | SOYMON013 | g2305013 | BLASTN | 521 | 1e-43 | 84 |
| 2128 | 16 | 700830984H1 | SOYMON019 | g497899 | BLASTN | 622 | 1e-43 | 86 |
| 2129 | 16 | 700906176H1 | SOYMON022 | g16508 | BLASTN | 623 | 1e-43 | 86 |
| 2130 | 16 | 701100070H2 | SOYMON028 | g16508 | BLASTN | 623 | 1e-43 | 91 |
| 2131 | 16 | 700954053H1 | SOYMON022 | g497899 | BLASTN | 624 | 1e-43 | 88 |
| 2132 | 16 | 700833949H1 | SOYMON019 | g497899 | BLASTN | 624 | 1e-43 | 88 |

TABLE A*-continued

METHIONINE ADENOSYLTRANSFERASE (EC 2.5.1.6)

| Seq No. | Cluster ID | CloneID | Library | NCBI gi | Method | Score | P-value | % Ident |
|---|---|---|---|---|---|---|---|---|
| 2133 | 16 | 700976710H1 | SOYMON009 | g2305013 | BLASTN | 625 | 1e-43 | 79 |
| 2134 | 16 | 701117925H2 | SOYMON037 | g16508 | BLASTN | 625 | 1e-43 | 84 |
| 2135 | 16 | 700748825H1 | SOYMON013 | g16508 | BLASTN | 626 | 1e-43 | 84 |
| 2136 | 16 | 700899651H1 | SOYMON027 | g16508 | BLASTN | 626 | 1e-43 | 84 |
| 2137 | 16 | 700746739H1 | SOYMON013 | g497899 | BLASTN | 626 | 1e-43 | 88 |
| 2138 | 16 | 701009051H1 | SOYMON019 | g16508 | BLASTN | 628 | 1e-43 | 91 |
| 2139 | 16 | 700754423H1 | SOYMON014 | g16508 | BLASTN | 628 | 1e-43 | 91 |
| 2140 | 16 | 700760701H1 | SOYMON015 | g16508 | BLASTN | 628 | 1e-43 | 83 |
| 2141 | 16 | 701098124H1 | SOYMON028 | g2305013 | BLASTN | 628 | 1e-43 | 78 |
| 2142 | 16 | 700984979H1 | SOYMON009 | g16508 | BLASTN | 628 | 1e-43 | 91 |
| 2143 | 16 | 700565262H1 | SOYMON002 | g497899 | BLASTN | 629 | 1e-43 | 86 |
| 2144 | 16 | 700954979H1 | SOYMON022 | g497899 | BLASTN | 630 | 1e-43 | 87 |
| 2145 | 16 | 700834601H1 | SOYMON019 | g497899 | BLASTN | 630 | 1e-43 | 87 |
| 2146 | 16 | 700953156H1 | SOYMON022 | g609224 | BLASTN | 630 | 1e-43 | 85 |
| 2147 | 16 | 700865217H1 | SOYMON016 | g16508 | BLASTN | 631 | 1e-43 | 77 |
| 2148 | 16 | 700852947H1 | SOYMON023 | g16508 | BLASTN | 631 | 1e-43 | 84 |
| 2149 | 16 | 700943547H1 | SOYMON024 | g497899 | BLASTN | 631 | 1e-43 | 86 |
| 2150 | 16 | 701139277H1 | SOYMON038 | g609224 | BLASTN | 632 | 1e-43 | 82 |
| 2151 | 16 | 700900155H1 | SOYMON027 | g429105 | BLASTN | 264 | 1e-42 | 81 |
| 2152 | 16 | 700970581H1 | SOYMON005 | g497899 | BLASTN | 296 | 1e-42 | 86 |
| 2153 | 16 | 700654232H1 | SOYMON003 | g497899 | BLASTN | 348 | 1e-42 | 88 |
| 2154 | 16 | 700743608H1 | SOYMON012 | g497899 | BLASTN | 354 | 1e-42 | 86 |
| 2155 | 16 | 700986620H1 | SOYMON009 | g609224 | BLASTN | 360 | 1e-42 | 84 |
| 2156 | 16 | 700562590H1 | SOYMON002 | g16508 | BLASTN | 476 | 1e-42 | 83 |
| 2157 | 16 | 701119690H1 | SOYMON037 | g167961 | BLASTN | 506 | 1e-42 | 84 |
| 2158 | 16 | 700951730H1 | SOYMON022 | g497899 | BLASTN | 507 | 1e-42 | 87 |
| 2159 | 16 | 701004525H1 | SOYMON019 | g16508 | BLASTN | 516 | 1e-42 | 91 |
| 2160 | 16 | 700892637H1 | SOYMON024 | g16508 | BLASTN | 523 | 1e-42 | 81 |
| 2161 | 16 | 700560679H1 | SOYMON001 | g16508 | BLASTN | 526 | 1e-42 | 83 |
| 2162 | 16 | 700897888H1 | SOYMON027 | g16508 | BLASTN | 611 | 1e-42 | 86 |
| 2163 | 16 | 700547973H1 | SOYMON001 | g497899 | BLASTN | 611 | 1e-42 | 84 |
| 2164 | 16 | 701012166H1 | SOYMON019 | g497899 | BLASTN | 612 | 1e-42 | 87 |
| 2165 | 16 | 700747550H1 | SOYMON013 | g16508 | BLASTN | 613 | 1e-42 | 84 |
| 2166 | 16 | 700946136H1 | SOYMON024 | g16508 | BLASTN | 615 | 1e-42 | 85 |
| 2167 | 16 | 700665932H1 | SOYMON005 | g16508 | BLASTN | 616 | 1e-42 | 84 |
| 2168 | 16 | 701010969H1 | SOYMON019 | g16508 | BLASTN | 618 | 1e-42 | 84 |
| 2169 | 16 | 700962515H1 | SOYMON022 | g16508 | BLASTN | 618 | 1e-42 | 91 |
| 2170 | 16 | 700895685H1 | SOYMON027 | g429107 | BLASTN | 618 | 1e-42 | 77 |
| 2171 | 16 | 700752015H1 | SOYMON014 | g16508 | BLASTN | 620 | 1e-42 | 84 |
| 2172 | 16 | 701015704H1 | SOYMON038 | g16508 | BLASTN | 620 | 1e-42 | 85 |
| 2173 | 16 | 700966710H1 | SOYMON028 | g16508 | BLASTN | 620 | 1e-42 | 83 |
| 2174 | 16 | 701004268H1 | SOYMON019 | g16508 | BLASTN | 620 | 1e-42 | 86 |
| 2175 | 16 | 701138901H1 | SOYMON038 | g497899 | BLASTN | 285 | 1e-41 | 85 |
| 2176 | 16 | 700648891H1 | SOYMON003 | g16508 | BLASTN | 481 | 1e-41 | 84 |
| 2177 | 16 | 700741421H1 | SOYMON012 | g609224 | BLASTN | 511 | 1e-41 | 82 |
| 2178 | 16 | 700555653H1 | SOYMON001 | g166873 | BLASTN | 512 | 1e-41 | 85 |
| 2179 | 16 | 700958314H1 | SOYMON022 | g497899 | BLASTN | 599 | 1e-41 | 87 |
| 2180 | 16 | 700960055H1 | SOYMON022 | g497899 | BLASTN | 599 | 1e-41 | 87 |
| 2181 | 16 | 700901925H1 | SOYMON027 | g16508 | BLASTN | 599 | 1e-41 | 84 |
| 2182 | 16 | 700741987H1 | SOYMON012 | g497899 | BLASTN | 599 | 1e-41 | 87 |
| 2183 | 16 | 700662837H1 | SOYMON005 | g497899 | BLASTN | 599 | 1e-41 | 87 |
| 2184 | 16 | 701060927H1 | SOYMON033 | g497899 | BLASTN | 599 | 1e-41 | 87 |
| 2185 | 16 | 700562973H1 | SOYMON002 | g16508 | BLASTN | 601 | 1e-41 | 87 |
| 2186 | 16 | 700754586H1 | SOYMON014 | g16508 | BLASTN | 603 | 1e-41 | 84 |
| 2187 | 16 | 701132674H1 | SOYMON038 | g16508 | BLASTN | 604 | 1e-41 | 85 |
| 2188 | 16 | 701010012H2 | SOYMON019 | g609224 | BLASTN | 604 | 1e-41 | 84 |
| 2189 | 16 | 701123643H1 | SOYMON037 | g16508 | BLASTN | 604 | 1e-41 | 85 |
| 2190 | 16 | 700894196H1 | SOYMON024 | g16508 | BLASTN | 604 | 1e-41 | 85 |
| 2191 | 16 | 700899248H1 | SOYMON027 | g16508 | BLASTN | 604 | 1e-41 | 85 |
| 2192 | 16 | 701207680H1 | SOYMON035 | g16508 | BLASTN | 605 | 1e-41 | 84 |
| 2193 | 16 | 700899210H1 | SOYMON027 | g16508 | BLASTN | 605 | 1e-41 | 84 |
| 2194 | 16 | 700898762H1 | SOYMON027 | g16508 | BLASTN | 605 | 1e-41 | 87 |
| 2195 | 16 | 700983636H1 | SOYMON009 | g497899 | BLASTN | 606 | 1e-41 | 87 |
| 2196 | 16 | 700845511H1 | SOYMON021 | g16508 | BLASTN | 606 | 1e-41 | 89 |
| 2197 | 16 | 700563416H1 | SOYMON002 | g16508 | BLASTN | 606 | 1e-41 | 83 |
| 2198 | 16 | 701004041H1 | SOYMON019 | g16508 | BLASTN | 607 | 1e-41 | 84 |
| 2199 | 16 | 701097184H1 | SOYMON028 | g16508 | BLASTN | 607 | 1e-41 | 87 |
| 2200 | 16 | 700750691H1 | SOYMON014 | g609224 | BLASTN | 608 | 1e-41 | 84 |
| 2201 | 16 | 701208091H1 | SOYMON035 | g16508 | BLASTN | 608 | 1e-41 | 84 |
| 2202 | 16 | 700973888H1 | SOYMON005 | g609224 | BLASTN | 609 | 1e-41 | 85 |
| 2203 | 16 | 700831972H1 | SOYMON019 | g16508 | BLASTN | 609 | 1e-41 | 85 |
| 2204 | 16 | 701010090H2 | SOYMON019 | g16508 | BLASTN | 610 | 1e-41 | 87 |
| 2205 | 16 | 700890067H1 | SOYMON024 | g16508 | BLASTN | 610 | 1e-41 | 87 |
| 2206 | 16 | 700833227H1 | SOYMON019 | g16508 | BLASTN | 610 | 1e-41 | 85 |
| 2207 | 16 | 700563171H1 | SOYMON002 | g16508 | BLASTN | 370 | 1e-40 | 90 |

TABLE A*-continued

METHIONINE ADENOSYLTRANSFERASE (EC 2.5.1.6)

| Seq No. | Cluster ID | CloneID | Library | NCBI gi | Method | Score | P-value | % Ident |
|---|---|---|---|---|---|---|---|---|
| 2208 | 16 | 701121457H1 | SOYMON037 | g609224 | BLASTN | 372 | 1e-40 | 85 |
| 2209 | 16 | 700566851H1 | SOYMON002 | g16508 | BLASTN | 402 | 1e-40 | 82 |
| 2210 | 16 | 700753221H1 | SOYMON014 | g609224 | BLASTN | 422 | 1e-40 | 84 |
| 2211 | 16 | 700749039H1 | SOYMON013 | g16508 | BLASTN | 475 | 1e-40 | 84 |
| 2212 | 16 | 700558940H1 | SOYMON001 | g16508 | BLASTN | 493 | 1e-40 | 80 |
| 2213 | 16 | 700757695H1 | SOYMON015 | g16508 | BLASTN | 526 | 1e-40 | 83 |
| 2214 | 16 | 701102262H1 | SOYMON028 | g2305013 | BLASTN | 587 | 1e-40 | 81 |
| 2215 | 16 | 700747484H1 | SOYMON013 | g16508 | BLASTN | 587 | 1e-40 | 85 |
| 2216 | 16 | 700891875H1 | SOYMON024 | g16508 | BLASTN | 587 | 1e-40 | 85 |
| 2217 | 16 | 700894439H1 | SOYMON024 | g497899 | BLASTN | 588 | 1e-40 | 88 |
| 2218 | 16 | 701062577H1 | SOYMON033 | g16508 | BLASTN | 588 | 1e-40 | 87 |
| 2219 | 16 | 700964366H1 | SOYMON022 | g16508 | BLASTN | 589 | 1e-40 | 85 |
| 2220 | 16 | 701210016H1 | SOYMON035 | g16508 | BLASTN | 589 | 1e-40 | 83 |
| 2221 | 16 | 700901573H1 | SOYMON027 | g16508 | BLASTN | 589 | 1e-40 | 85 |
| 2222 | 16 | 700750533H1 | SOYMON014 | g16508 | BLASTN | 589 | 1e-40 | 85 |
| 2223 | 16 | 700888820H1 | SOYMON024 | g497899 | BLASTN | 589 | 1e-40 | 87 |
| 2224 | 16 | 700891965H1 | SOYMON024 | g497899 | BLASTN | 589 | 1e-40 | 87 |
| 2225 | 16 | 700865001H1 | SOYMON016 | g16508 | BLASTN | 589 | 1e-40 | 85 |
| 2226 | 16 | 700654923H1 | SOYMON004 | g16508 | BLASTN | 590 | 1e-40 | 84 |
| 2227 | 16 | 700746169H1 | SOYMON013 | g16508 | BLASTN | 590 | 1e-40 | 84 |
| 2228 | 16 | 700745792H1 | SOYMON013 | g16508 | BLASTN | 591 | 1e-40 | 85 |
| 2229 | 16 | 700966953H1 | SOYMON029 | g16508 | BLASTN | 591 | 1e-40 | 85 |
| 2230 | 16 | 701141657H1 | SOYMON038 | g16508 | BLASTN | 592 | 1e-40 | 86 |
| 2231 | 16 | 700943078H1 | SOYMON024 | g16508 | BLASTN | 598 | 1e-40 | 85 |
| 2232 | 16 | 701137073H1 | SOYMON038 | g16508 | BLASTN | 598 | 1e-40 | 90 |
| 2233 | 16 | 700966730H1 | SOYMON028 | g16508 | BLASTN | 598 | 1e-40 | 84 |
| 2234 | 16 | 701137731H1 | SOYMON038 | g16508 | BLASTN | 371 | 1e-39 | 84 |
| 2235 | 16 | 701044050H1 | SOYMON032 | g497899 | BLASTN | 428 | 1e-39 | 89 |
| 2236 | 16 | 700993309H1 | SOYMON011 | g497899 | BLASTN | 434 | 1e-39 | 88 |
| 2237 | 16 | 700874483H1 | SOYMON018 | g497899 | BLASTN | 434 | 1e-39 | 87 |
| 2238 | 16 | 701014866H1 | SOYMON019 | g16508 | BLASTN | 454 | 1e-39 | 89 |
| 2239 | 16 | 700894603H1 | SOYMON024 | g16508 | BLASTN | 454 | 1e-39 | 85 |
| 2240 | 16 | 700958677H1 | SOYMON022 | g497899 | BLASTN | 455 | 1e-39 | 87 |
| 2241 | 16 | 700754001H1 | SOYMON014 | g609224 | BLASTN | 518 | 1e-39 | 85 |
| 2242 | 16 | 700946430H1 | SOYMON024 | g497899 | BLASTN | 578 | 1e-39 | 87 |
| 2243 | 16 | 700729892H1 | SOYMON009 | g497899 | BLASTN | 578 | 1e-39 | 87 |
| 2244 | 16 | 700753230H1 | SOYMON014 | g497899 | BLASTN | 578 | 1e-39 | 87 |
| 2245 | 16 | 700562584H1 | SOYMON002 | g16508 | BLASTN | 578 | 1e-39 | 82 |
| 2246 | 16 | 700842880H1 | SOYMON020 | g16508 | BLASTN | 580 | 1e-39 | 82 |
| 2247 | 16 | 700852561H1 | SOYMON023 | g16508 | BLASTN | 582 | 1e-39 | 85 |
| 2248 | 16 | 700941290H1 | SOYMON024 | g497899 | BLASTN | 583 | 1e-39 | 87 |
| 2249 | 16 | 700750361H1 | SOYMON013 | g497899 | BLASTN | 584 | 1e-39 | 80 |
| 2250 | 16 | 700841915H1 | SOYMON020 | g16508 | BLASTN | 585 | 1e-39 | 85 |
| 2251 | 16 | 700944462H1 | SOYMON024 | g16508 | BLASTN | 585 | 1e-39 | 85 |
| 2252 | 16 | 700548174H1 | SOYMON002 | g16508 | BLASTN | 342 | 1e-38 | 82 |
| 2253 | 16 | 700942324H1 | SOYMON024 | g497899 | BLASTN | 403 | 1e-38 | 87 |
| 2254 | 16 | 700788450H1 | SOYMON011 | g497899 | BLASTN | 416 | 1e-38 | 86 |
| 2255 | 16 | 701127954H1 | SOYMON037 | g16508 | BLASTN | 449 | 1e-38 | 76 |
| 2256 | 16 | 700742223H1 | SOYMON012 | g1724103 | BLASTN | 451 | 1e-38 | 77 |
| 2257 | 16 | 701102722H1 | SOYMON028 | g16508 | BLASTN | 466 | 1e-38 | 92 |
| 2258 | 16 | 701046957H1 | SOYMON032 | g16508 | BLASTN | 517 | 1e-38 | 85 |
| 2259 | 16 | 700836169H1 | SOYMON019 | g497899 | BLASTN | 517 | 1e-38 | 87 |
| 2260 | 16 | 700697967H1 | SOYMON015 | g16508 | BLASTN | 521 | 1e-38 | 84 |
| 2261 | 16 | 700678867H1 | SOYMON007 | g609224 | BLASTN | 566 | 1e-38 | 82 |
| 2262 | 16 | 700838753H1 | SOYMON020 | g16508 | BLASTN | 567 | 1e-38 | 85 |
| 2263 | 16 | 700726468H1 | SOYMON009 | g16508 | BLASTN | 570 | 1e-38 | 85 |
| 2264 | 16 | 701014631H1 | SOYMON019 | g497899 | BLASTN | 571 | 1e-38 | 87 |
| 2265 | 16 | 700728719H1 | SOYMON009 | g497899 | BLASTN | 573 | 1e-38 | 87 |
| 2266 | 16 | 700962582H1 | SOYMON022 | g497899 | BLASTN | 573 | 1e-38 | 87 |
| 2267 | 16 | 701123183H1 | SOYMON037 | g16508 | BLASTN | 573 | 1e-38 | 84 |
| 2268 | 16 | 700752347H1 | SOYMON014 | g16508 | BLASTN | 574 | 1e-38 | 87 |
| 2269 | 16 | 701103315H1 | SOYMON028 | g16508 | BLASTN | 394 | 1e-37 | 86 |
| 2270 | 16 | 700750955H1 | SOYMON014 | g497899 | BLASTN | 414 | 1e-37 | 88 |
| 2271 | 16 | 700867493H1 | SOYMON016 | g609224 | BLASTN | 433 | 1e-37 | 85 |
| 2272 | 16 | 701054760H1 | SOYMON032 | g16508 | BLASTN | 475 | 1e-37 | 85 |
| 2273 | 16 | 700900903H1 | SOYMON027 | g16508 | BLASTN | 501 | 1e-37 | 84 |
| 2274 | 16 | 701102294H1 | SOYMON028 | g16508 | BLASTN | 502 | 1e-37 | 87 |
| 2275 | 16 | 701124034H1 | SOYMON037 | g16508 | BLASTN | 512 | 1e-37 | 82 |
| 2276 | 16 | 700981476H1 | SOYMON009 | g16508 | BLASTN | 526 | 1e-37 | 83 |
| 2277 | 16 | 700903712H1 | SOYMON022 | g609224 | BLASTN | 552 | 1e-37 | 85 |
| 2278 | 16 | 700648751H1 | SOYMON003 | g1655577 | BLASTN | 554 | 1e-37 | 86 |
| 2279 | 16 | 700829930H1 | SOYMON019 | g609224 | BLASTN | 556 | 1e-37 | 84 |
| 2280 | 16 | 700758078H1 | SOYMON015 | g16508 | BLASTN | 556 | 1e-37 | 84 |
| 2281 | 16 | 700754248H1 | SOYMON014 | g16508 | BLASTN | 557 | 1e-37 | 81 |
| 2282 | 16 | 700834650H1 | SOYMON019 | g609224 | BLASTN | 557 | 1e-37 | 85 |

TABLE A*-continued

METHIONINE ADENOSYLTRANSFERASE (EC 2.5.1.6)

| Seq No. | Cluster ID | CloneID | Library | NCBI gi | Method | Score | P-value | % Ident |
|---|---|---|---|---|---|---|---|---|
| 2283 | 16 | 700746279H1 | SOYMON013 | g16508 | BLASTN | 558 | 1e−37 | 82 |
| 2284 | 16 | 700869124H1 | SOYMON016 | g16508 | BLASTN | 559 | 1e−37 | 83 |
| 2285 | 16 | 701100219H1 | SOYMON028 | g2305013 | BLASTN | 560 | 1e−37 | 80 |
| 2286 | 16 | 700992589H1 | SOYMON011 | g497899 | BLASTN | 560 | 1e−37 | 80 |
| 2287 | 16 | 700865642H1 | SOYMON016 | g16508 | BLASTN | 562 | 1e−37 | 84 |
| 2288 | 16 | 701068835H1 | SOYMON034 | g429105 | BLASTN | 321 | 1e−36 | 86 |
| 2289 | 16 | 700746908H1 | SOYMON013 | g16508 | BLASTN | 373 | 1e−36 | 81 |
| 2290 | 16 | 700954719H1 | SOYMON022 | g16508 | BLASTN | 475 | 1e−36 | 86 |
| 2291 | 16 | 701042790H1 | SOYMON029 | g497899 | BLASTN | 489 | 1e−36 | 88 |
| 2292 | 16 | 700835259H1 | SOYMON019 | g497899 | BLASTN | 507 | 1e−36 | 88 |
| 2293 | 16 | 700565816H1 | SOYMON002 | g16508 | BLASTN | 519 | 1e−36 | 82 |
| 2294 | 16 | 700895811H1 | SOYMON027 | g609224 | BLASTN | 540 | 1e−36 | 83 |
| 2295 | 16 | 700975709H1 | SOYMON009 | g609224 | BLASTN | 541 | 1e−36 | 84 |
| 2296 | 16 | 700751645H1 | SOYMON014 | g16508 | BLASTN | 542 | 1e−36 | 85 |
| 2297 | 16 | 700567087H1 | SOYMON002 | g16508 | BLASTN | 542 | 1e−36 | 85 |
| 2298 | 16 | 700893027H1 | SOYMON024 | g609224 | BLASTN | 542 | 1e−36 | 85 |
| 2299 | 16 | 700891185H1 | SOYMON024 | g609224 | BLASTN | 543 | 1e−36 | 84 |
| 2300 | 16 | 700851376H1 | SOYMON023 | g16508 | BLASTN | 543 | 1e−36 | 83 |
| 2301 | 16 | 700898322H1 | SOYMON027 | g609224 | BLASTN | 547 | 1e−36 | 85 |
| 2302 | 16 | 700762881H1 | SOYMON015 | g16508 | BLASTN | 323 | 1e−35 | 85 |
| 2303 | 16 | 700960023H1 | SOYMON022 | g16508 | BLASTN | 370 | 1e−35 | 90 |
| 2304 | 16 | 701136486H1 | SOYMON038 | g497899 | BLASTN | 378 | 1e−35 | 85 |
| 2305 | 16 | 700987688H1 | SOYMON009 | g497899 | BLASTN | 387 | 1e−35 | 83 |
| 2306 | 16 | 700836508H1 | SOYMON020 | g16508 | BLASTN | 431 | 1e−35 | 85 |
| 2307 | 16 | 700990779H1 | SOYMON011 | g167961 | BLASTN | 471 | 1e−35 | 86 |
| 2308 | 16 | 700753019H1 | SOYMON014 | g497899 | BLASTN | 476 | 1e−35 | 83 |
| 2309 | 16 | 701138490H1 | SOYMON038 | g16508 | BLASTN | 481 | 1e−35 | 83 |
| 2310 | 16 | 700751771H1 | SOYMON014 | g609224 | BLASTN | 528 | 1e−35 | 84 |
| 2311 | 16 | 701048324H1 | SOYMON032 | g609224 | BLASTN | 529 | 1e−35 | 84 |
| 2312 | 16 | 700835739H1 | SOYMON019 | g16508 | BLASTN | 532 | 1e−35 | 85 |
| 2313 | 16 | 700986295H1 | SOYMON009 | g497899 | BLASTN | 533 | 1e−35 | 86 |
| 2314 | 16 | 701205693H1 | SOYMON035 | g16508 | BLASTN | 535 | 1e−35 | 84 |
| 2315 | 16 | 700865674H1 | SOYMON016 | g609224 | BLASTN | 536 | 1e−35 | 85 |
| 2316 | 16 | 700943777H1 | SOYMON024 | g16508 | BLASTN | 536 | 1e−35 | 84 |
| 2317 | 16 | 700968207H1 | SOYMON035 | g609224 | BLASTN | 536 | 1e−35 | 85 |
| 2318 | 16 | 700898370H1 | SOYMON027 | g609224 | BLASTN | 536 | 1e−35 | 85 |
| 2319 | 16 | 700987890H1 | SOYMON009 | g609224 | BLASTN | 536 | 1e−35 | 85 |
| 2320 | 16 | 700896016H1 | SOYMON027 | g609224 | BLASTN | 536 | 1e−35 | 85 |
| 2321 | 16 | 700554440H1 | SOYMON001 | g16508 | BLASTN | 283 | 1e−34 | 82 |
| 2322 | 16 | 700789855H2 | SOYMON011 | g16508 | BLASTN | 293 | 1e−34 | 91 |
| 2323 | 16 | 701101393H1 | SOYMON028 | g16508 | BLASTN | 311 | 1e−34 | 84 |
| 2324 | 16 | 700946335H1 | SOYMON024 | g16508 | BLASTN | 323 | 1e−34 | 86 |
| 2325 | 16 | 701207420H1 | SOYMON035 | g169664 | BLASTN | 350 | 1e−34 | 88 |
| 2326 | 16 | 700733034H1 | SOYMON010 | g16508 | BLASTN | 384 | 1e−34 | 81 |
| 2327 | 16 | 700790653H2 | SOYMON011 | g497899 | BLASTN | 399 | 1e−34 | 81 |
| 2328 | 16 | 700901808H1 | SOYMON027 | g497899 | BLASTN | 430 | 1e−34 | 81 |
| 2329 | 16 | 700760954H1 | SOYMON015 | g609224 | BLASTN | 514 | 1e−34 | 84 |
| 2330 | 16 | 700896206H1 | SOYMON027 | g16508 | BLASTN | 516 | 1e−34 | 85 |
| 2331 | 16 | 701039157H1 | SOYMON029 | g609224 | BLASTN | 520 | 1e−34 | 76 |
| 2332 | 16 | 700991056H1 | SOYMON011 | g166873 | BLASTN | 520 | 1e−34 | 80 |
| 2333 | 16 | 701097173H1 | SOYMON028 | g609224 | BLASTN | 521 | 1e−34 | 85 |
| 2334 | 16 | 700900989H1 | SOYMON027 | g497899 | BLASTN | 521 | 1e−34 | 86 |
| 2335 | 16 | 700895584H1 | SOYMON027 | g609224 | BLASTN | 521 | 1e−34 | 85 |
| 2336 | 16 | 700726668H1 | SOYMON009 | g16508 | BLASTN | 521 | 1e−34 | 85 |
| 2337 | 16 | 701011191H1 | SOYMON019 | g16508 | BLASTN | 521 | 1e−34 | 85 |
| 2338 | 16 | 701100827H1 | SOYMON028 | g16508 | BLASTN | 522 | 1e−34 | 84 |
| 2339 | 16 | 701156732H1 | SOYMON031 | g16508 | BLASTN | 522 | 1e−34 | 84 |
| 2340 | 16 | 700889752H1 | SOYMON024 | g609224 | BLASTN | 523 | 1e−34 | 84 |
| 2341 | 16 | 701105873H1 | SOYMON036 | g16508 | BLASTN | 524 | 1e−34 | 87 |
| 2342 | 16 | 700958346H1 | SOYMON022 | g497899 | BLASTN | 525 | 1e−34 | 84 |
| 2343 | 16 | 700962972H1 | SOYMON022 | g609224 | BLASTN | 525 | 1e−34 | 84 |
| 2344 | 16 | 701055918H1 | SOYMON032 | g16508 | BLASTN | 526 | 1e−34 | 85 |
| 2345 | 16 | 701123061H1 | SOYMON037 | g16508 | BLASTN | 526 | 1e−34 | 85 |
| 2346 | 16 | 701109796H1 | SOYMON036 | g166873 | BLASTN | 335 | 1e−33 | 86 |
| 2347 | 16 | 701207350H1 | SOYMON035 | g497899 | BLASTN | 349 | 1e−33 | 89 |
| 2348 | 16 | 700835692H1 | SOYMON019 | g16508 | BLASTN | 377 | 1e−33 | 81 |
| 2349 | 16 | 700729083H1 | SOYMON009 | g16508 | BLASTN | 448 | 1e−33 | 85 |
| 2350 | 16 | LIB3040-049-Q1-E1-E8 | LIB3040 | g16508 | BLASTN | 464 | 1e−33 | 80 |
| 2351 | 16 | 700896567H1 | SOYMON027 | g497899 | BLASTN | 502 | 1e−33 | 81 |
| 2352 | 16 | 700668032H1 | SOYMON006 | g609224 | BLASTN | 504 | 1e−33 | 85 |
| 2353 | 16 | 700895062H1 | SOYMON024 | g609224 | BLASTN | 505 | 1e−33 | 83 |
| 2354 | 16 | 700961178H1 | SOYMON022 | g16508 | BLASTN | 506 | 1e−33 | 84 |
| 2355 | 16 | 701202590H1 | SOYMON035 | g497899 | BLASTN | 508 | 1e−33 | 86 |
| 2356 | 16 | 700754960H1 | SOYMON014 | g16508 | BLASTN | 512 | 1e−33 | 83 |
| 2357 | 16 | 700748584H1 | SOYMON013 | g16508 | BLASTN | 512 | 1e−33 | 84 |

TABLE A*-continued

METHIONINE ADENOSYLTRANSFERASE (EC 2.5.1.6)

| Seq No. | Cluster ID | CloneID | Library | NCBI gi | Method | Score | P-value | % Ident |
|---|---|---|---|---|---|---|---|---|
| 2358 | 16 | 700791669H1 | SOYMON011 | g609224 | BLASTN | 512 | 1e−33 | 84 |
| 2359 | 16 | 701210405H1 | SOYMON035 | g16508 | BLASTN | 526 | 1e−33 | 83 |
| 2360 | 16 | LIB3040-054-Q1-E1-D8 | LIB3040 | g16508 | BLASTN | 531 | 1e−33 | 80 |
| 2361 | 16 | 700791176H1 | SOYMON011 | g497899 | BLASTN | 311 | 1e−32 | 87 |
| 2362 | 16 | LIB3049-029-Q1-E1-C5 | LIB3049 | g167961 | BLASTN | 368 | 1e−32 | 73 |
| 2363 | 16 | 700893458H1 | SOYMON024 | g497899 | BLASTN | 380 | 1e−32 | 87 |
| 2364 | 16 | 700829728H1 | SOYMON019 | g497899 | BLASTN | 490 | 1e−32 | 88 |
| 2365 | 16 | 700833137H1 | SOYMON019 | g609224 | BLASTN | 490 | 1e−32 | 85 |
| 2366 | 16 | 701204592H2 | SOYMON035 | g609224 | BLASTN | 493 | 1e−32 | 86 |
| 2367 | 16 | 700834821H1 | SOYMON019 | g609224 | BLASTN | 494 | 1e−32 | 78 |
| 2368 | 16 | 700757167H1 | SOYMON015 | g16508 | BLASTN | 494 | 1e−32 | 85 |
| 2369 | 16 | 701203730H2 | SOYMON035 | g16508 | BLASTN | 496 | 1e−32 | 82 |
| 2370 | 16 | 701044359H1 | SOYMON032 | g609224 | BLASTN | 497 | 1e−32 | 84 |
| 2371 | 16 | 701010095H2 | SOYMON019 | g16508 | BLASTN | 498 | 1e−32 | 86 |
| 2372 | 16 | 701100059H2 | SOYMON028 | g16508 | BLASTN | 499 | 1e−32 | 80 |
| 2373 | 16 | 700844256H1 | SOYMON021 | g16508 | BLASTN | 500 | 1e−32 | 80 |
| 2374 | 16 | 700968296H1 | SOYMON035 | g497899 | BLASTN | 501 | 1e−32 | 85 |
| 2375 | 16 | 701110404H1 | SOYMON036 | g16508 | BLASTN | 333 | 1e−31 | 84 |
| 2376 | 16 | 700869025H1 | SOYMON016 | g497899 | BLASTN | 340 | 1e−31 | 86 |
| 2377 | 16 | 700556245H1 | SOYMON001 | g609224 | BLASTN | 355 | 1e−31 | 84 |
| 2378 | 16 | 700566166H1 | SOYMON002 | g726031 | BLASTN | 402 | 1e−31 | 77 |
| 2379 | 16 | 700941481H1 | SOYMON024 | g497899 | BLASTN | 423 | 1e−31 | 79 |
| 2380 | 16 | 700896940H1 | SOYMON027 | g169664 | BLASTN | 477 | 1e−31 | 85 |
| 2381 | 16 | 701145429H1 | SOYMON031 | g609224 | BLASTN | 478 | 1e−31 | 85 |
| 2382 | 16 | 700946496H1 | SOYMON024 | g609224 | BLASTN | 488 | 1e−31 | 86 |
| 2383 | 16 | 700902149H1 | SOYMON027 | g1655577 | BLASTN | 488 | 1e−31 | 87 |
| 2384 | 16 | 700653072H1 | SOYMON003 | g497899 | BLASTN | 489 | 1e−31 | 88 |
| 2385 | 16 | 701000261H1 | SOYMON018 | g16508 | BLASTN | 495 | 1e−31 | 78 |
| 2386 | 16 | 701039358H1 | SOYMON029 | g609224 | BLASTN | 320 | 1e−30 | 85 |
| 2387 | 16 | 701156951H1 | SOYMON031 | g609224 | BLASTN | 467 | 1e−30 | 86 |
| 2388 | 16 | 701040880H1 | SOYMON029 | g497899 | BLASTN | 477 | 1e−30 | 89 |
| 2389 | 16 | 700979632H2 | SQYMON009 | g609224 | BLASTN | 490 | 1e−30 | 83 |
| 2390 | 16 | 700983678H1 | SOYMON009 | g16508 | BLASTN | 192 | 1e−29 | 86 |
| 2391 | 16 | 700893644H1 | SOYMON024 | g609224 | BLASTN | 320 | 1e−29 | 85 |
| 2392 | 16 | 700962437H1 | SOYMON022 | g609224 | BLASTN | 364 | 1e−29 | 83 |
| 2393 | 16 | 701150545H1 | SOYMON031 | g16508 | BLASTN | 457 | 1e−29 | 86 |
| 2394 | 16 | 700555403H1 | SOYMON001 | g16508 | BLASTN | 458 | 1e−29 | 90 |
| 2395 | 16 | 700794307H1 | SOYMON017 | g16508 | BLASTN | 460 | 1e−29 | 87 |
| 2396 | 16 | 701137971H1 | SOYMON038 | g16508 | BLASTN | 460 | 1e−29 | 84 |
| 2397 | 16 | 700893774H1 | SOYMON024 | g609224 | BLASTN | 461 | 1e−29 | 86 |
| 2398 | 16 | 700565272H1 | SOYMON002 | g609224 | BLASTN | 464 | 1e−29 | 74 |
| 2399 | 16 | 700667161H1 | SOYMON006 | g16508 | BLASTN | 468 | 1e−29 | 75 |
| 2400 | 16 | 700752952H1 | SOYMON014 | g609224 | BLASTN | 279 | 1e−28 | 78 |
| 2401 | 16 | 700901534H1 | SOYMON027 | g2305013 | BLASTN | 288 | 1e−28 | 85 |
| 2402 | 16 | 701006617H1 | SOYMON019 | g497899 | BLASTN | 358 | 1e−28 | 79 |
| 2403 | 16 | 700753459H1 | SOYMON014 | g609224 | BLASTN | 446 | 1e−28 | 81 |
| 2404 | 16 | 701157089H1 | SOYMON031 | g609224 | BLASTN | 448 | 1e−28 | 84 |
| 2405 | 16 | 700831271H1 | SOYMON019 | g16508 | BLASTN | 453 | 1e−28 | 87 |
| 2406 | 16 | 701207325H1 | SOYMON035 | g167961 | BLASTN | 251 | 1e−27 | 81 |
| 2407 | 16 | 700566121H1 | SOYMON002 | g16508 | BLASTN | 259 | 1e−27 | 75 |
| 2408 | 16 | 701137878H1 | SOYMON038 | g609224 | BLASTN | 280 | 1e−27 | 85 |
| 2409 | 16 | 700763957H1 | SOYMON019 | g497899 | BLASTN | 430 | 1e−27 | 88 |
| 2410 | 16 | 701015858H1 | SOYMON038 | g609224 | BLASTN | 431 | 1e−27 | 86 |
| 2411 | 16 | 700742849H1 | SOYMON012 | g497899 | BLASTN | 434 | 1e−27 | 88 |
| 2412 | 16 | 701102648H1 | SOYMON028 | g16508 | BLASTN | 436 | 1e−27 | 89 |
| 2413 | 16 | 700940955H1 | SOYMON024 | g609556 | BLASTN | 438 | 1e−27 | 85 |
| 2414 | 16 | 700889805H1 | SOYMON024 | g16508 | BLASTN | 441 | 1e−27 | 89 |
| 2415 | 16 | 701061930H1 | SOYMON033 | g16508 | BLASTN | 315 | 1e−26 | 77 |
| 2416 | 16 | 700901375H1 | SOYMON027 | g609224 | BLASTN | 323 | 1e−26 | 84 |
| 2417 | 16 | 700989056H1 | SOYMON011 | g609224 | BLASTN | 345 | 1e−26 | 82 |
| 2418 | 16 | 700665988H1 | SOYMON005 | g960356 | BLASTN | 420 | 1e−26 | 79 |
| 2419 | 16 | 700893352H1 | SOYMON024 | g497899 | BLASTN | 428 | 1e−26 | 87 |
| 2420 | 16 | 701122945H1 | SOYMON037 | g16508 | BLASTN | 269 | 1e−25 | 76 |
| 2421 | 16 | 700992929H1 | SOYMON011 | g16508 | BLASTN | 328 | 1e−25 | 78 |
| 2422 | 16 | 700557564H1 | SOYMON001 | g609224 | BLASTN | 413 | 1e−25 | 85 |
| 2423 | 16 | 701102620H1 | SOYMON028 | g609224 | BLASTN | 414 | 1e−25 | 82 |
| 2424 | 16 | 701062321H1 | SOYMON033 | g497899 | BLASTN | 267 | 1e−24 | 87 |
| 2425 | 16 | 701062258H1 | SOYMON033 | g450548 | BLASTN | 391 | 1e−24 | 83 |
| 2426 | 16 | 701145703H1 | SOYMON031 | g609224 | BLASTN | 411 | 1e−24 | 85 |
| 2427 | 16 | 701144943H1 | SOYMON031 | g450548 | BLASTN | 421 | 1e−24 | 85 |
| 2428 | 16 | 701134190H1 | SOYMON038 | g2305013 | BLASTN | 268 | 1e−23 | 87 |
| 2429 | 16 | 701132116H1 | SOYMON038 | g450548 | BLASTN | 385 | 1e−23 | 85 |
| 2430 | 16 | 701144522H1 | SOYMON031 | g450548 | BLASTN | 406 | 1e−23 | 85 |
| 2431 | 16 | 700738002H1 | SOYMON012 | g1655578 | BLASTX | 205 | 1e−21 | 84 |
| 2432 | 16 | 700756686H1 | SOYMON014 | g16508 | BLASTN | 235 | 1e−21 | 76 |

TABLE A*-continued

METHIONINE ADENOSYLTRANSFERASE (EC 2.5.1.6)

| Seq No. | Cluster ID | CloneID | Library | NCBI gi | Method | Score | P-value | % Ident |
|---|---|---|---|---|---|---|---|---|
| 2433 | 16 | 700649058H1 | SOYMON003 | g16508 | BLASTN | 360 | 1e-21 | 85 |
| 2434 | 16 | 701152050H1 | SOYMON031 | g497899 | BLASTN | 233 | 1e-20 | 87 |
| 2435 | 16 | 701156991H1 | SOYMON031 | g497900 | BLASTX | 146 | 1e-19 | 98 |
| 2436 | 16 | 700761949H1 | SOYMON015 | g497900 | BLASTX | 173 | 1e-19 | 98 |
| 2437 | 16 | 700988163H1 | SOYMON009 | g609224 | BLASTN | 243 | 1e-19 | 81 |
| 2438 | 16 | 700666050H1 | SOYMON005 | g960357 | BLASTX | 183 | 1e-18 | 89 |
| 2439 | 16 | 700896896H1 | SOYMON027 | g497900 | BLASTX | 95 | 1e-17 | 82 |
| 2440 | 16 | 701100249H1 | SOYMON028 | g497900 | BLASTX | 104 | 1e-17 | 79 |
| 2441 | 16 | 701061719H1 | SOYMON033 | g609224 | BLASTN | 310 | 1e-17 | 67 |
| 2442 | 16 | 700674836H1 | SOYMON007 | g16508 | BLASTN | 331 | 1e-17 | 84 |
| 2443 | 16 | 700908822H1 | SOYMON022 | g169665 | BLASTX | 171 | 1e-16 | 100 |
| 2444 | 16 | 700898670H1 | SOYMON027 | g166872 | BLASTX | 172 | 1e-16 | 93 |
| 2445 | 16 | 700650967H1 | SOYMON003 | g16845 | BLASTX | 147 | 1e-15 | 100 |
| 2446 | 16 | 701132185H1 | SOYMON038 | g16845 | BLASTX | 151 | 1e-15 | 100 |
| 2447 | 16 | 700648929H1 | SOYMON003 | g1033190 | BLASTX | 156 | 1e-14 | 96 |
| 2448 | 16 | 700960809H1 | SOYMON022 | g16508 | BLASTX | 168 | 1e-14 | 88 |
| 2449 | 16 | 701101753H1 | SOYMON028 | g16845 | BLASTX | 141 | 1e-13 | 88 |
| 2450 | 16 | 700742010H1 | SOYMON012 | g609224 | BLASTN | 273 | 1e-13 | 88 |
| 2451 | 16 | 700735080H1 | SOYMON010 | g166874 | BLASTX | 121 | 1e-12 | 86 |
| 2452 | 16 | 700979242H1 | SOYMON009 | g609224 | BLASTN | 165 | 1e-12 | 81 |
| 2453 | 16 | 700740838H1 | SOYMON012 | g609224 | BLASTN | 253 | 1e-12 | 88 |
| 2454 | 16 | 700832383H1 | SOYMON019 | g16845 | BLASTX | 82 | 1e-11 | 71 |
| 2455 | 16 | 700830938H1 | SOYMON019 | g16845 | BLASTX | 92 | 1e-11 | 90 |
| 2456 | 16 | 700564686H1 | SOYMON002 | g1655578 | BLASTX | 95 | 1e-11 | 97 |
| 2457 | 16 | 700753178H1 | SOYMON014 | g16845 | BLASTX | 107 | 1e-10 | 78 |
| 2458 | 16 | 700563834H1 | SOYMON002 | g497900 | BLASTX | 124 | 1e-10 | 100 |
| 2459 | 16 | 700897739H1 | SOYMON027 | g16845 | BLASTX | 125 | 1e-10 | 86 |
| 2460 | 16 | 700725722H1 | SOYMON009 | g609225 | BLASTX | 125 | 1e-10 | 92 |
| 2461 | 16 | 701210357H1 | SOYMON035 | g497900 | BLASTX | 128 | 1e-10 | 100 |
| 2462 | 16 | 700833654H1 | SOYMON019 | g609224 | BLASTN | 243 | 1e-10 | 87 |
| 2463 | 16 | 701010334H1 | SOYMON019 | g609224 | BLASTN | 258 | 1e-10 | 86 |
| 2464 | 16 | 700567622H1 | SOYMON002 | g166874 | BLASTX | 93 | 1e-9 | 100 |
| 2465 | 16 | 700647933H1 | SOYMON003 | g609225 | BLASTX | 120 | 1e-9 | 81 |
| 2466 | 16 | 700742255H1 | SOYMON012 | g429107 | BLASTN | 160 | 1e-9 | 86 |
| 2467 | 16 | 700981506H1 | SOYMON009 | g609224 | BLASTN | 248 | 1e-9 | 88 |
| 2468 | 16 | 700962044H1 | SOYMON022 | g497900 | BLASTX | 113 | 1e-8 | 100 |
| 2469 | 16 | 701039604H1 | SOYMON029 | g497900 | BLASTX | 113 | 1e-8 | 100 |
| 2470 | 16 | 701009941H2 | SOYMON019 | g609225 | BLASTX | 114 | 1e-8 | 70 |
| 2471 | 16 | 700976956H1 | SOYMON009 | g609225 | BLASTX | 118 | 1e-8 | 96 |
| 2472 | 18138 | 701120722H1 | SOYMON037 | g169664 | BLASTN | 514 | 1e-33 | 92 |
| 2473 | 18138 | 700946044H1 | SOYMON024 | g169664 | BLASTN | 437 | 1e-26 | 90 |
| 2474 | 18138 | 700664443H1 | SOYMON005 | g17262 | BLASTX | 162 | 1e-16 | 88 |
| 2475 | 18138 | 700665162H1 | SOYMON005 | g17262 | BLASTX | 162 | 1e-16 | 88 |
| 2476 | 18138 | 701143667H1 | SOYMON038 | g16961 | BLASTX | 123 | 1e-11 | 95 |
| 2477 | 18138 | 701099150H1 | SOYMON028 | g16961 | BLASTX | 112 | 1e-9 | 90 |
| 2478 | 27686 | 700909141H1 | SOYMON022 | g726027 | BLASTN | 723 | 1e-51 | 84 |
| 2479 | 27686 | 701145458H1 | SOYMON031 | g726027 | BLASTN | 694 | 1e-49 | 86 |

ADENOSYLMETHIONINE DECARBOXYLASE (EC 4.1.1.50)

| Seq No. | Cluster ID | CloneID | Library | NCBI gi | Method | Score | P-value | % Ident |
|---|---|---|---|---|---|---|---|---|
| 430 | -700151703 | 700151703H1 | SATMON007 | g1532072 | BLASTN | 717 | 1e-50 | 91 |
| 431 | -700165608 | 700165608H1 | SATMON013 | g1532072 | BLASTN | 605 | 1e-41 | 75 |
| 432 | -700166868 | 700166868H1 | SATMON013 | g1532072 | BLASTN | 593 | 1e-40 | 90 |
| 433 | -700242148 | 700242148H1 | SATMON010 | g1532048 | BLASTX | 142 | 1e-12 | 88 |
| 434 | -700354923 | 700354923H1 | SATMON024 | g1532072 | BLASTN | 887 | 1e-74 | 89 |
| 435 | -700422279 | 700422279H1 | SATMONN01 | g1532072 | BLASTN | 623 | 1e-61 | 88 |
| 436 | -700455682 | 700455682H1 | SATMON029 | g1532047 | BLASTN | 681 | 1e-47 | 77 |
| 437 | -700477645 | 700477645H1 | SATMON025 | g1532048 | BLASTX | 90 | 1e-12 | 71 |
| 438 | -700550509 | 700550509H1 | SATMON022 | g1532047 | BLASTN | 399 | 1e-41 | 80 |
| 439 | -700572502 | 700572502H1 | SATMON030 | g1532048 | BLASTX | 93 | 1e-20 | 70 |
| 440 | -700618258 | 700618258H1 | SATMON033 | g1532072 | BLASTN | 368 | 1e-67 | 92 |
| 441 | -701165456 | 701165456H1 | SATMONN04 | g1532072 | BLASTN | 436 | 1e-26 | 71 |
| 442 | -L30622289 | LIB3062-004-Q1-K1-E10 | LIB3062 | g1532047 | BLASTN | 406 | 1e-26 | 82 |
| 443 | -L30623185 | LIB3062-026-Q1-K1-E2 | LIB3062 | g1532072 | BLASTN | 338 | 1e-19 | 62 |
| 444 | -L30625601 | LIB3062-033-Q1-K1-A9 | LIB3062 | g1403043 | BLASTN | 758 | 1e-54 | 68 |
| 445 | -L30661842 | LIB3066-009-Q1-K1-E4 | LIB3066 | g1532072 | BLASTN | 398 | 1e-22 | 86 |
| 446 | -L30681932 | LIB3068-020-Q1-K1-C8 | LIB3068 | g1532072 | BLASTN | 205 | 1e-28 | 89 |
| 447 | -L30687176 | LIB3068-059-Q1-K1-C1 | LIB3068 | g1532072 | BLASTN | 216 | 1e-20 | 87 |

ADENOSYLMETHIONINE DECARBOXYLASE (EC 4.1.1.50)

| Seq No. | Cluster ID | CloneID | Library | NCBI gi | Method | Score | P-value | % Ident |
|---|---|---|---|---|---|---|---|---|
| 448 | -L30692075 | LIB3069-004-Q1-K1-G11 | LIB3069 | g1532072 | BLASTN | 619 | 1e-40 | 90 |
| 449 | -L30783194 | LIB3078-052-Q1-K1-E4 | LIB3078 | g1532072 | BLASTN | 447 | 1e-40 | 76 |
| 450 | -L30792336 | LIB3079-021-Q1-K1-E12 | LIB3079 | g1532072 | BLASTN | 217 | 1e-13 | 80 |
| 451 | 1471 | 700106762H1 | SATMON010 | g1532072 | BLASTN | 323 | 1e-59 | 84 |
| 452 | 1471 | 701163744H1 | SATMONN04 | g1532072 | BLASTN | 220 | 1e-41 | 86 |
| 453 | 1471 | LIB3059-023-Q1-K1-A11 | LIB3059 | g1532072 | BLASTN | 340 | 1e-39 | 80 |
| 454 | 1471 | 700574530H1 | SATMON030 | g1532072 | BLASTN | 247 | 1e-34 | 82 |
| 455 | 1471 | LIB83-003-Q1-E1-G1 | LIB83 | g1532072 | BLASTN | 239 | 1e-24 | 80 |
| 456 | 1471 | 701161147H1 | SATMONN04 | g1532072 | BLASTN | 239 | 1e-16 | 80 |
| 457 | 1471 | 700477336H1 | SATMON025 | g1532072 | BLASTN | 235 | 1e-10 | 91 |
| 458 | 16729 | 700169502H1 | SATMON013 | g1403043 | BLASTN | 456 | 1e-28 | 65 |
| 459 | 16729 | 700088201H1 | SATMON011 | g1532048 | BLASTX | 123 | 1e-22 | 60 |
| 460 | 16729 | 700165440H1 | SATMON013 | g1532048 | BLASTX | 162 | 1e-15 | 65 |
| 461 | 16866 | 700072905H1 | SATMON007 | g1532047 | BLASTN | 368 | 1e-19 | 71 |
| 462 | 16866 | 700350558H1 | SATMON023 | g1532047 | BLASTN | 301 | 1e-14 | 70 |
| 463 | 16866 | 700088370H1 | SATMON011 | g1532047 | BLASTN | 306 | 1e-14 | 70 |
| 464 | 2324 | LIB3066-042-Q1-K1-H2 | LIB3066 | g1403043 | BLASTN | 1344 | 1e-103 | 79 |
| 465 | 2324 | LIB3059-01 1-Q1-K1-B2 | LIB3059 | g1403043 | BLASTN | 1351 | 1e-103 | 78 |
| 466 | 2324 | LIB3059-042-Q1-K1-B7 | LIB3059 | g1403043 | BLASTN | 1230 | 1e-100 | 80 |
| 467 | 2324 | LIB3062-036-Q1-K1-F2 | LIB3062 | g1532072 | BLASTN | 1097 | 1e-91 | 80 |
| 468 | 2324 | LIB3069-020-Q1-K1-A5 | LIB3069 | g1403043 | BLASTN | 925 | 1e-82 | 80 |
| 469 | 2324 | LIB189-023-Q1-E1-H3 | LIB189 | g1532072 | BLASTN | 1085 | 1e-81 | 78 |
| 470 | 2324 | 700266088H1 | SATMON017 | g1532047 | BLASTN | 998 | 1e-74 | 80 |
| 471 | 2324 | LIB3062-026-Q1-K1-E6 | LIB3062 | g1532047 | BLASTN | 982 | 1e-72 | 77 |
| 472 | 2324 | 700083335H1 | SATMON011 | g1403043 | BLASTN | 960 | 1e-71 | 79 |
| 473 | 2324 | LIB189-015-Q1-E1-D3 | LIB189 | g1532047 | BLASTN | 970 | 1e-71 | 77 |
| 474 | 2324 | LIB3079-013-Q1-K1-B3 | LIB3079 | g1403043 | BLASTN | 953 | 1e-70 | 81 |
| 475 | 2324 | 700262129H1 | SATMON017 | g1403043 | BLASTN | 936 | 1e-69 | 79 |
| 476 | 2324 | 700265667H1 | SATMON017 | g1403043 | BLASTN | 694 | 1e-66 | 81 |
| 477 | 2324 | 700807255H1 | SATMON036 | g1532072 | BLASTN | 850 | 1e-62 | 81 |
| 478 | 2324 | 700196129H1 | SATMON014 | g1403043 | BLASTN | 853 | 1e-62 | 83 |
| 479 | 2324 | LIB3066-042-Q1-K1-H1 | LIB3066 | g1403043 | BLASTN | 842 | 1e-61 | 80 |
| 480 | 2324 | 700458321H1 | SATMON029 | g1403043 | BLASTN | 501 | 1e-58 | 80 |
| 481 | 2324 | 700197643H1 | SATMON014 | g1403043 | BLASTN | 461 | 1e-57 | 80 |
| 482 | 2324 | LIB143-029-Q1-E1-H3 | LIB143 | g1532072 | BLASTN | 786 | 1e-56 | 78 |
| 483 | 2324 | 700197842H1 | SATMON014 | g1403043 | BLASTN | 688 | 1e-48 | 85 |
| 484 | 2324 | 700196807H1 | SATMON014 | g1532072 | BLASTN | 678 | 1e-47 | 75 |
| 485 | 2324 | 700263712H1 | SATMON017 | g1532072 | BLASTN | 403 | 1e-45 | 75 |
| 486 | 2324 | LIB143-006-Q1-E1-F9 | LIB143 | g1403043 | BLASTN | 324 | 1e-42 | 83 |
| 487 | 2324 | 700267496H1 | SATMON017 | g1532047 | BLASTN | 594 | 1e-40 | 83 |
| 488 | 2324 | 700172551H1 | SATMON013 | g1532072 | BLASTN | 546 | 1e-36 | 74 |
| 489 | 2324 | 700211893H1 | SATMON016 | g1532047 | BLASTN | 542 | 1e-35 | 82 |
| 490 | 2324 | 700264065H1 | SATMON017 | g1532047 | BLASTN | 515 | 1e-34 | 83 |
| 491 | 2324 | 700465305H1 | SATMON025 | g1532073 | BLASTX | 148 | 1e-26 | 61 |
| 492 | 2324 | 700455052H1 | SATMON029 | g1403043 | BLASTN | 274 | 1e-26 | 79 |
| 493 | 2324 | 700473305H1 | SATMON025 | g1403043 | BLASTN | 446 | 1e-26 | 74 |
| 494 | 2324 | 700475851H1 | SATMON025 | g1532047 | BLASTN | 333 | 1e-18 | 78 |
| 495 | 2324 | 700263111H1 | SATMON017 | g1532073 | BLASTX | 165 | 1e-15 | 72 |
| 496 | 2324 | 700465705H1 | SATMON025 | g1403044 | BLASTX | 78 | 1e-8 | 76 |
| 497 | 3185 | 700264424H1 | SATMON017 | g1403043 | BLASTN | 469 | 1e-41 | 81 |
| 498 | 3185 | LIB143-007-Q1-E1-H2 | LIB143 | g1403043 | BLASTN | 464 | 1e-36 | 80 |
| 499 | 3185 | 700262548H1 | SATMON017 | g1532047 | BLASTN | 368 | 1e-34 | 80 |
| 500 | 3185 | 700263845H1 | SATMON017 | g1403043 | BLASTN | 455 | 1e-34 | 81 |
| 501 | 3185 | LIB3068-025-Q1-K1-G10 | LIB3068 | g1403043 | BLASTN | 288 | 1e-32 | 81 |
| 502 | 3185 | 700264569H1 | SATMON017 | g1403043 | BLASTN | 469 | 1e-32 | 82 |
| 503 | 3185 | 700243571H1 | SATMON010 | g1532047 | BLASTN | 461 | 1e-28 | 77 |
| 504 | 3185 | 700265453H1 | SATMON017 | g1532047 | BLASTN | 269 | 1e-27 | 84 |
| 505 | 3185 | 700267779H1 | SATMON017 | g1532047 | BLASTN | 257 | 1e-26 | 85 |
| 506 | 3185 | 700382373H1 | SATMON024 | g1532047 | BLASTN | 255 | 1e-24 | 86 |
| 507 | 3185 | 700258727H1 | SATMON017 | g1532047 | BLASTN | 255 | 1e-24 | 84 |
| 508 | 3185 | LIB3069-018-Q1-K1-F5 | LIB3069 | g1532047 | BLASTN | 255 | 1e-21 | 77 |
| 509 | 3185 | LIB3066-038-Q1-K1-C2 | LIB3066 | g1403043 | BLASTN | 242 | 1e-17 | 68 |
| 510 | 3185 | 700334654H1 | SATMON019 | g1532047 | BLASTN | 248 | 1e-17 | 90 |
| 511 | 3185 | 700262830H1 | SATMON017 | g1403043 | BLASTN | 276 | 1e-12 | 78 |
| 512 | 3185 | 700264727H1 | SATMON017 | g1532047 | BLASTN | 255 | 1e-10 | 92 |
| 513 | 3185 | 700238407H1 | SATMON010 | g1532047 | BLASTN | 255 | 1e-10 | 92 |
| 514 | 3185 | 700441952H1 | SATMON026 | g1532047 | BLASTN | 255 | 1e-10 | 92 |
| 515 | 3185 | 700268188H1 | SATMON017 | g1532047 | BLASTN | 255 | 1e-10 | 92 |
| 516 | 3185 | 700801627H1 | SATMON036 | g1532047 | BLASTN | 255 | 1e-10 | 92 |
| 517 | 3185 | 700261609H1 | SATMON017 | g1532047 | BLASTN | 255 | 1e-10 | 92 |
| 518 | 3185 | 700258510H1 | SATMON017 | g1532047 | BLASTN | 255 | 1e-10 | 92 |
| 519 | 3185 | 700258779H1 | SATMON017 | g1532047 | BLASTN | 255 | 1e-10 | 92 |
| 520 | 3185 | 700256838H1 | SATMON017 | g1532047 | BLASTN | 255 | 1e-10 | 92 |
| 521 | 3185 | 700263361H1 | SATMON017 | g1532047 | BLASTN | 255 | 1e-10 | 92 |
| 522 | 3185 | 700257102H1 | SATMON017 | g1532047 | BLASTN | 255 | 1e-10 | 92 |

-continued

ADENOSYLMETHIONINE DECARBOXYLASE (EC 4.1.1.50)

| Seq No. | Cluster ID | CloneID | Library | NCBI gi | Method | Score | P-value | % Ident |
|---|---|---|---|---|---|---|---|---|
| 523 | 3185 | 700239452H1 | SATMON010 | g1532047 | BLASTN | 245 | 1e-9 | 91 |
| 524 | 3185 | 700262045H1 | SATMON017 | g1532047 | BLASTN | 250 | 1e-9 | 90 |
| 525 | 8 | LIB3066-027-Q1-K1-C6 | LIB3066 | g1532072 | BLASTN | 1414 | 1e-181 | 97 |
| 526 | 8 | LIB3066-048-Q1-K1-C9 | LIB3066 | g1532072 | BLASTN | 1715 | 1e-173 | 98 |
| 527 | 8 | LIB3066-007-Q1-K1-B4 | LIB3066 | g1532072 | BLASTN | 2146 | 1e-170 | 97 |
| 528 | 8 | LIB3066-019-Q1-K1-B9 | LIB3066 | g1532072 | BLASTN | 1884 | 1e-168 | 98 |
| 529 | 8 | LIB148-038-Q1-E1-A3 | LIB148 | g1532072 | BLASTN | 1585 | 1e-164 | 99 |
| 530 | 8 | LIB3068-002-Q1-K1-H5 | LIB3068 | g1532072 | BLASTN | 2051 | 1e-162 | 98 |
| 531 | 8 | LIB3067-035-Q1-K1-E9 | LIB3067 | g1532072 | BLASTN | 1594 | 1e-161 | 98 |
| 532 | 8 | LIB189-020-Q1-E1-E8 | LIB189 | g1532072 | BLASTN | 1501 | 1e-160 | 98 |
| 533 | 8 | LIB3078-057-Q1-K1-C12 | LIB3078 | g1532072 | BLASTN | 2026 | 1e-160 | 96 |
| 534 | 8 | LIB3066-053-Q1-K1-A8 | LIB3066 | g1532072 | BLASTN | 1713 | 1e-159 | 93 |
| 535 | 8 | LIB189-006-Q1-E1-C6 | LIB189 | g1532072 | BLASTN | 1676 | 1e-157 | 98 |
| 536 | 8 | LIB3078-054-Q1-K1-E4 | LIB3078 | g1532072 | BLASTN | 1997 | 1e-157 | 95 |
| 537 | 8 | LIB3069-028-Q1-K1-A11 | LIB3069 | g1532072 | BLASTN | 1980 | 1e-156 | 96 |
| 538 | 8 | LIB3069-045-Q1-K1-H7 | LIB3069 | g1532072 | BLASTN | 1989 | 1e-156 | 98 |
| 539 | 8 | LIB148-025-Q1-E1-F7 | LIB148 | g1532072 | BLASTN | 1954 | 1e-154 | 97 |
| 540 | 8 | LIB189-014-Q1-E1-F11 | LIB189 | g1532072 | BLASTN | 1925 | 1e-151 | 94 |
| 541 | 8 | LIB3060-014-Q1-K1-C5 | LIB3060 | g1532072 | BLASTN | 1780 | 1e-150 | 96 |
| 542 | 8 | LIB148-057-Q1-E1-C2 | LIB148 | g1532072 | BLASTN | 1000 | 1e-149 | 98 |
| 543 | 8 | LIB148-015-Q1-E1-F2 | LIB148 | g1532072 | BLASTN | 1886 | 1e-148 | 94 |
| 544 | 8 | LIB3066-045-Q1-K1-A2 | LIB3066 | g1532072 | BLASTN | 914 | 1e-146 | 91 |
| 545 | 8 | LIB148-064-Q1-E1-A3 | LIB148 | g1532072 | BLASTN | 1660 | 1e-146 | 93 |
| 546 | 8 | LIB3061-047-Q1-K1-G1 | LIB3061 | g1532072 | BLASTN | 1867 | 1e-146 | 92 |
| 547 | 8 | LIB148-040-Q1-E1-F1 | LIB148 | g1532072 | BLASTN | 1706 | 1e-145 | 94 |
| 548 | 8 | LIB3069-012-Q1-K1-B6 | LIB3069 | g1532072 | BLASTN | 1630 | 1e-144 | 87 |
| 549 | 8 | LIB3068-009-Q1-K1-A8 | LIB3068 | g1532072 | BLASTN | 1802 | 1e-141 | 97 |
| 550 | 8 | LIB148-004-Q1-E1-D2 | LIB148 | g1532072 | BLASTN | 818 | 1e-139 | 91 |
| 551 | 8 | LIB3068-002-Q1-K1-A1 | LIB3068 | g1532072 | BLASTN | 944 | 1e-137 | 95 |
| 552 | 8 | LIB3067-035-Q1-K1-H9 | LIB3067 | g1532072 | BLASTN | 1701 | 1e-137 | 98 |
| 553 | 8 | LIB3068-033-Q1-K1-G12 | LIB3068 | g1532072 | BLASTN | 1093 | 1e-130 | 89 |
| 554 | 8 | 700572229H1 | SATMON030 | g1532072 | BLASTN | 1135 | 1e-128 | 99 |
| 555 | 8 | LIB3078-052-Q1-K1-E1 | LIB3078 | g1532072 | BLASTN | 1235 | 1e-127 | 85 |
| 556 | 8 | 700572579H1 | SATMON030 | g1532072 | BLASTN | 1625 | 1e-126 | 98 |
| 557 | 8 | LIB3066-025-Q1-K1-F2 | LIB3066 | g1532072 | BLASTN | 1625 | 1e-126 | 100 |
| 558 | 8 | LIB3068-048-Q1-K1-F9 | LIB3068 | g1532072 | BLASTN | 1538 | 1e-125 | 98 |
| 559 | 8 | 700098413H1 | SATMON009 | g1532072 | BLASTN | 1595 | 1e-124 | 100 |
| 560 | 8 | 700573235H1 | SATMON030 | g1532072 | BLASTN | 1513 | 1e-123 | 98 |
| 561 | 8 | 700090946H1 | SATMON011 | g1532072 | BLASTN | 1585 | 1e-123 | 100 |
| 562 | 8 | 700092465H1 | SATMON008 | g1532072 | BLASTN | 1541 | 1e-122 | 98 |
| 563 | 8 | 700074625H1 | SATMON007 | g1532072 | BLASTN | 1570 | 1e-122 | 100 |
| 564 | 8 | LIB3059-007-Q1-K1-C10 | LIB3059 | g1532072 | BLASTN | 1401 | 1e-119 | 94 |
| 565 | 8 | 700072828H1 | SATMON007 | g1532072 | BLASTN | 1540 | 1e-119 | 100 |
| 566 | 8 | 700619106H1 | SATMON034 | g1532072 | BLASTN | 833 | 1e-118 | 97 |
| 567 | 8 | 700074853H1 | SATMON007 | g1532072 | BLASTN | 1515 | 1e-117 | 100 |
| 568 | 8 | 700201293H1 | SATMON003 | g1532072 | BLASTN | 1517 | 1e-117 | 97 |
| 569 | 8 | 700075896H1 | SATMON007 | g1532072 | BLASTN | 1006 | 1e-115 | 99 |
| 570 | 8 | LIB3059-052-Q1-K1-A1 | LIB3059 | g1532072 | BLASTN | 1241 | 1e-115 | 92 |
| 571 | 8 | 700091576H1 | SATMON011 | g1532072 | BLASTN | 943 | 1e-114 | 98 |
| 572 | 8 | LIB3078-015-Q1-K1-D7 | LIB3078 | g1532072 | BLASTN | 1218 | 1e-114 | 87 |
| 573 | 8 | 700074733H1 | SATMON007 | g1532072 | BLASTN | 1475 | 1e-114 | 100 |
| 574 | 8 | 700381421H1 | SATMON023 | g1532072 | BLASTN | 1475 | 1e-114 | 100 |
| 575 | 8 | 700085594H1 | SATMON011 | g1532072 | BLASTN | 1477 | 1e-114 | 99 |
| 576 | 8 | 700095883H1 | SATMON008 | g1532072 | BLASTN | 1477 | 1e-114 | 99 |
| 577 | 8 | 700338237H1 | SATMON020 | g1532072 | BLASTN | 1478 | 1e-114 | 99 |
| 578 | 8 | 700549813H1 | SATMON022 | g1532072 | BLASTN | 1481 | 1e-114 | 99 |
| 579 | 8 | 700097935H1 | SATMON009 | g1532072 | BLASTN | 1484 | 1e-114 | 98 |
| 580 | 8 | 700572978H1 | SATMON030 | g1532072 | BLASTN | 865 | 1e-113 | 96 |
| 581 | 8 | 700196464H1 | SATMON014 | g1532072 | BLASTN | 1044 | 1e-113 | 92 |
| 582 | 8 | 700381412H1 | SATMON023 | g1532072 | BLASTN | 1168 | 1e-113 | 98 |
| 583 | 8 | 700027839H1 | SATMON003 | g1532072 | BLASTN | 1472 | 1e-113 | 99 |
| 584 | 8 | 700623344H1 | SATMON034 | g1532072 | BLASTN | 1085 | 1e-112 | 94 |
| 585 | 8 | 700025858H1 | SATMON003 | g1532072 | BLASTN | 1455 | 1e-112 | 100 |
| 586 | 8 | LIB3059-017-Q1-K1-H5 | LIB3059 | g1532072 | BLASTN | 1459 | 1e-112 | 97 |
| 587 | 8 | 700475019H1 | SATMON025 | g1532072 | BLASTN | 1390 | 1e-111 | 100 |
| 588 | 8 | 700338357H1 | SATMON020 | g1532072 | BLASTN | 1440 | 1e-111 | 100 |
| 589 | 8 | 700256796H1 | SATMON017 | g1532072 | BLASTN | 1400 | 1e-110 | 100 |
| 590 | 8 | 700071692H1 | SATMON007 | g1532072 | BLASTN | 1430 | 1e-110 | 98 |
| 591 | 8 | 700339073H1 | SATMON020 | g1532072 | BLASTN | 1357 | 1e-109 | 95 |
| 592 | 8 | 700106916H1 | SATMON010 | g1532072 | BLASTN | 1415 | 1e-109 | 93 |
| 593 | 8 | 700468234H1 | SATMON025 | g1532072 | BLASTN | 1420 | 1e-109 | 100 |
| 594 | 8 | 700214482H1 | SATMON016 | g1532072 | BLASTN | 1425 | 1e-109 | 100 |
| 595 | 8 | 700466437H1 | SATMON025 | g1532072 | BLASTN | 1403 | 1e-108 | 98 |
| 596 | 8 | 700205576H1 | SATMON003 | g1532072 | BLASTN | 1404 | 1e-108 | 98 |
| 597 | 8 | 700043455H1 | SATMON004 | g1532072 | BLASTN | 1405 | 1e-108 | 100 |

-continued

ADENOSYLMETHIONINE DECARBOXYLASE (EC 4.1.1.50)

| Seq No. | Cluster ID | CloneID | Library | NCBI gi | Method | Score | P-value | % Ident |
|---|---|---|---|---|---|---|---|---|
| 598 | 8 | 700348439H1 | SATMON023 | g1532072 | BLASTN | 1407 | 1e−108 | 99 |
| 599 | 8 | 700093131H1 | SATMON008 | g1532072 | BLASTN | 755 | 1e−107 | 100 |
| 600 | 8 | 700571851H1 | SATMON030 | g1532072 | BLASTN | 1302 | 1e−107 | 99 |
| 601 | 8 | 700088142H1 | SATMON011 | g1532072 | BLASTN | 1392 | 1e−107 | 99 |
| 602 | 8 | 700085934H1 | SATMON011 | g1532072 | BLASTN | 1397 | 1e−107 | 98 |
| 603 | 8 | 700028465H1 | SATMON003 | g1532072 | BLASTN | 1258 | 1e−106 | 98 |
| 604 | 8 | 700236818H1 | SATMON010 | g1532072 | BLASTN | 1380 | 1e−106 | 100 |
| 605 | 8 | 700583691H1 | SATMON031 | g1532072 | BLASTN | 1382 | 1e−106 | 99 |
| 606 | 8 | 700095585H1 | SATMON008 | g1532072 | BLASTN | 1383 | 1e−106 | 94 |
| 607 | 8 | 700105140H1 | SATMON010 | g1532072 | BLASTN | 1375 | 1e−105 | 100 |
| 608 | 8 | 700338486H1 | SATMON020 | g1532072 | BLASTN | 893 | 1e−104 | 98 |
| 609 | 8 | 700214178H1 | SATMON016 | g1532072 | BLASTN | 1361 | 1e−104 | 99 |
| 610 | 8 | 700090613H1 | SATMON011 | g1532072 | BLASTN | 699 | 1e−103 | 99 |
| 611 | 8 | 700576189H1 | SATMON030 | g1532072 | BLASTN | 1254 | 1e−103 | 93 |
| 612 | 8 | 700475734H1 | SATMON025 | g1532072 | BLASTN | 1256 | 1e−103 | 99 |
| 613 | 8 | 700028218H1 | SATMON003 | g1532072 | BLASTN | 1275 | 1e−103 | 100 |
| 614 | 8 | 700088644H1 | SATMON011 | g1532072 | BLASTN | 1351 | 1e−103 | 98 |
| 615 | 8 | 700378768H1 | SATMON020 | g1532072 | BLASTN | 1067 | 1e−102 | 98 |
| 616 | 8 | LIB3067-035-Q1-K1-H10 | LIB3067 | g1532072 | BLASTN | 1233 | 1e−102 | 95 |
| 617 | 8 | 700043466H1 | SATMON004 | g1532072 | BLASTN | 1331 | 1e−102 | 97 |
| 618 | 8 | LIB148-057-Q1-E1-C3 | LIB148 | g1532072 | BLASTN | 1283 | 1e−101 | 92 |
| 619 | 8 | 700217574H1 | SATMON016 | g1532072 | BLASTN | 1320 | 1e−101 | 100 |
| 620 | 8 | 700042332H1 | SATMON004 | g1532072 | BLASTN | 1321 | 1e−101 | 97 |
| 621 | 8 | 700440926H1 | SATMON026 | g1532072 | BLASTN | 1323 | 1e−101 | 99 |
| 622 | 8 | 700552284H1 | SATMON022 | g1532072 | BLASTN | 1329 | 1e−101 | 97 |
| 623 | 8 | 700216613H1 | SATMON016 | g1532072 | BLASTN | 689 | 1e−100 | 97 |
| 624 | 8 | LIB3067-054-Q1-K1-F6 | LIB3067 | g1532072 | BLASTN | 1030 | 1e−100 | 94 |
| 625 | 8 | LIB3060-038-Q1-K1-B9 | LIB3060 | g1532072 | BLASTN | 1108 | 1e−100 | 92 |
| 626 | 8 | 700218755H1 | SATMON011 | g1532072 | BLASTN | 1116 | 1e−100 | 99 |
| 627 | 8 | 700338042H1 | SATMON020 | g1532072 | BLASTN | 1270 | 1e−100 | 99 |
| 628 | 8 | 700268009H1 | SATMON017 | g1532072 | BLASTN | 1307 | 1e−100 | 92 |
| 629 | 8 | 700578491H1 | SATMON031 | g1532072 | BLASTN | 1309 | 1e−100 | 97 |
| 630 | 8 | 700030037H1 | SATMON003 | g1532072 | BLASTN | 1310 | 1e−100 | 97 |
| 631 | 8 | 700221406H1 | SATMON011 | g1532072 | BLASTN | 1315 | 1e−100 | 100 |
| 632 | 8 | 700157357H1 | SATMON012 | g1532072 | BLASTN | 1315 | 1e−100 | 98 |
| 633 | 8 | 700476926H1 | SATMON025 | g1532072 | BLASTN | 680 | 1e−99 | 97 |
| 634 | 8 | 700475068H1 | SATMON025 | g1532072 | BLASTN | 792 | 1e−99 | 98 |
| 635 | 8 | 700469741H1 | SATMON025 | g1532072 | BLASTN | 831 | 1e−99 | 99 |
| 636 | 8 | 700082377H1 | SATMON011 | g1532072 | BLASTN | 1081 | 1e−99 | 99 |
| 637 | 8 | 700217143H1 | SATMON016 | g1532072 | BLASTN | 1208 | 1e−99 | 98 |
| 638 | 8 | 700339433H1 | SATMON020 | g1532072 | BLASTN | 1295 | 1e−99 | 100 |
| 639 | 8 | 700196627H1 | SATMON014 | g1532072 | BLASTN | 1295 | 1e−99 | 100 |
| 640 | 8 | 700259354H1 | SATMON017 | g1532072 | BLASTN | 1305 | 1e−99 | 92 |
| 641 | 8 | 700610842H1 | SATMON022 | g1532072 | BLASTN | 843 | 1e−98 | 97 |
| 642 | 8 | 700218059H1 | SATMON016 | g1532072 | BLASTN | 1036 | 1e−98 | 99 |
| 643 | 8 | 700421727H1 | SATMONN01 | g1532072 | BLASTN | 1172 | 1e−98 | 97 |
| 644 | 8 | 700158660H1 | SATMON012 | g1532072 | BLASTN | 1285 | 1e−98 | 100 |
| 645 | 8 | 700806856H1 | SATMON036 | g1532072 | BLASTN | 1194 | 1e−97 | 97 |
| 646 | 8 | 700583512H1 | SATMON031 | g1532072 | BLASTN | 1219 | 1e−97 | 97 |
| 647 | 8 | 700025502H1 | SATMON004 | g1532072 | BLASTN | 1276 | 1e−97 | 99 |
| 648 | 8 | 700159562H1 | SATMON012 | g1532072 | BLASTN | 1277 | 1e−97 | 99 |
| 649 | 8 | 700223731H1 | SATMON011 | g1532072 | BLASTN | 1277 | 1e−97 | 99 |
| 650 | 8 | 700156494H1 | SATMON012 | g1532072 | BLASTN | 1280 | 1e−97 | 100 |
| 651 | 8 | 700160533H1 | SATMON012 | g1532072 | BLASTN | 1281 | 1e−97 | 97 |
| 652 | 8 | LIB3066-055-Q1-K1-D8 | LIB3066 | g1532072 | BLASTN | 672 | 1e−96 | 99 |
| 653 | 8 | 700405152H1 | SATMON028 | g1532072 | BLASTN | 828 | 1e−96 | 98 |
| 654 | 8 | LIB148-040-Q1-E1-A8 | LIB148 | g1532072 | BLASTN | 1268 | 1e−96 | 83 |
| 655 | 8 | 700438437H1 | SATMON026 | g1532072 | BLASTN | 1246 | 1e−95 | 99 |
| 656 | 8 | 700267245H1 | SATMON017 | g1532072 | BLASTN | 1248 | 1e−95 | 93 |
| 657 | 8 | 700156129H2 | SATMON007 | g1532072 | BLASTN | 1250 | 1e−95 | 100 |
| 658 | 8 | 700203246H1 | SATMON003 | g1532072 | BLASTN | 1250 | 1e−95 | 100 |
| 659 | 8 | 700168339H1 | SATMON013 | g1532072 | BLASTN | 915 | 1e−94 | 98 |
| 660 | 8 | LIB3067-036-Q1-K1-F9 | LIB3067 | g1532072 | BLASTN | 1110 | 1e−94 | 95 |
| 661 | 8 | 700193769H1 | SATMON014 | g1532072 | BLASTN | 1240 | 1e−94 | 100 |
| 662 | 8 | 700094014H1 | SATMON008 | g1532072 | BLASTN | 1241 | 1e−94 | 91 |
| 663 | 8 | 700020311H1 | SATMON001 | g1532072 | BLASTN | 1228 | 1e−93 | 99 |
| 664 | 8 | 700195083H1 | SATMON014 | g1532072 | BLASTN | 1229 | 1e−93 | 98 |
| 665 | 8 | 700193901H1 | SATMON014 | g1532072 | BLASTN | 1229 | 1e−93 | 98 |
| 666 | 8 | 700194639H1 | SATMON014 | g1532072 | BLASTN | 1231 | 1e−93 | 99 |
| 667 | 8 | 700350117H1 | SATMON023 | g1532072 | BLASTN | 1143 | 1e−92 | 99 |
| 668 | 8 | 700239867H1 | SATMON010 | g1532072 | BLASTN | 1210 | 1e−92 | 98 |
| 669 | 8 | LIB3069-028-Q1-K1-D1 | LIB3069 | g1532072 | BLASTN | 1217 | 1e−92 | 94 |
| 670 | 8 | 700355756H1 | SATMON024 | g1532072 | BLASTN | 618 | 1e−91 | 96 |
| 671 | 8 | 700265492H1 | SATMON017 | g1532072 | BLASTN | 620 | 1e−91 | 94 |
| 672 | 8 | 700579021H1 | SATMON031 | g1532072 | BLASTN | 656 | 1e−91 | 96 |

-continued

ADENOSYLMETHIONINE DECARBOXYLASE (EC 4.1.1.50)

| Seq No. | Cluster ID | CloneID | Library | NCBI gi | Method | Score | P-value | % Ident |
|---|---|---|---|---|---|---|---|---|
| 673 | 8 | LIB3079-015-Q1-K1-B11 | LIB3079 | g1532072 | BLASTN | 1008 | 1e−91 | 83 |
| 674 | 8 | 700572888H2 | SATMON030 | g1532072 | BLASTN | 1159 | 1e−91 | 99 |
| 675 | 8 | 701183990H1 | SATMONN06 | g1532072 | BLASTN | 1198 | 1e−91 | 93 |
| 676 | 8 | 700085757H1 | SATMON011 | g1532072 | BLASTN | 1200 | 1e−91 | 100 |
| 677 | 8 | 700162756H1 | SATMON013 | g1532072 | BLASTN | 1208 | 1e−91 | 99 |
| 678 | 8 | 700193076H1 | SATMON014 | g1532072 | BLASTN | 1208 | 1e−91 | 99 |
| 679 | 8 | 700224378H1 | SATMON011 | g1532072 | BLASTN | 696 | 1e−90 | 99 |
| 680 | 8 | 700218773H1 | SATMON011 | g1532072 | BLASTN | 1187 | 1e−90 | 93 |
| 681 | 8 | 700159338H1 | SATMON012 | g1532072 | BLASTN | 1193 | 1e−90 | 97 |
| 682 | 8 | 700169217H1 | SATMON013 | g1532072 | BLASTN | 1196 | 1e−90 | 99 |
| 683 | 8 | 700551548H1 | SATMON022 | g1532072 | BLASTN | 839 | 1e−89 | 96 |
| 684 | 8 | 700197059H1 | SATMON014 | g1532072 | BLASTN | 1025 | 1e−89 | 95 |
| 685 | 8 | 700469834H1 | SATMON025 | g1532072 | BLASTN | 650 | 1e−88 | 97 |
| 686 | 8 | 700569778H1 | SATMON030 | g1532072 | BLASTN | 682 | 1e−88 | 91 |
| 687 | 8 | 700194845H1 | SATMON014 | g1532072 | BLASTN | 1171 | 1e−88 | 99 |
| 688 | 8 | 700445861H1 | SATMON027 | g1532072 | BLASTN | 536 | 1e−87 | 99 |
| 689 | 8 | 700100536H1 | SATMON009 | g1532072 | BLASTN | 666 | 1e−87 | 94 |
| 690 | 8 | 701163801H1 | SATMONN04 | g1532072 | BLASTN | 805 | 1e−87 | 94 |
| 691 | 8 | LIB3060-035-Q1-K1-E3 | LIB3060 | g1532072 | BLASTN | 922 | 1e−87 | 95 |
| 692 | 8 | 700170872H1 | SATMON013 | g1532072 | BLASTN | 943 | 1e−87 | 97 |
| 693 | 8 | 700241270H1 | SATMON010 | g1532072 | BLASTN | 1066 | 1e−86 | 96 |
| 694 | 8 | 700457981H1 | SATMON029 | g1532072 | BLASTN | 1140 | 1e−86 | 92 |
| 695 | 8 | 700158339H1 | SATMON012 | g1532072 | BLASTN | 1142 | 1e−86 | 99 |
| 696 | 8 | 700019442H1 | SATMON001 | g1532072 | BLASTN | 1145 | 1e−86 | 100 |
| 697 | 8 | 700149885H1 | SATMON007 | g1532072 | BLASTN | 1133 | 1e−85 | 99 |
| 698 | 8 | 700018255H1 | SATMON001 | g1532072 | BLASTN | 1135 | 1e−85 | 100 |
| 699 | 8 | 700244026H1 | SATMON010 | g1532072 | BLASTN | 1044 | 1e−84 | 89 |
| 700 | 8 | LIB3060-027-Q1-K1-B2 | LIB3060 | g1532072 | BLASTN | 1117 | 1e−84 | 99 |
| 701 | 8 | 700170960H1 | SATMON013 | g1532072 | BLASTN | 696 | 1e−83 | 99 |
| 702 | 8 | 700267487H1 | SATMON017 | g1532072 | BLASTN | 1061 | 1e−83 | 92 |
| 703 | 8 | 700152754H1 | SATMON007 | g1532072 | BLASTN | 1107 | 1e−83 | 99 |
| 704 | 8 | 700378260H1 | SATMON019 | g1532072 | BLASTN | 1112 | 1e−83 | 92 |
| 705 | 8 | 700455089H1 | SATMON029 | g1532072 | BLASTN | 583 | 1e−82 | 97 |
| 706 | 8 | 700167322H1 | SATMON013 | g1532072 | BLASTN | 1080 | 1e−81 | 98 |
| 707 | 8 | LIB3060-035-Q1-K1-H1 | LIB3060 | g1532072 | BLASTN | 782 | 1e−80 | 94 |
| 708 | 8 | 700204067H1 | SATMON003 | g1532072 | BLASTN | 1011 | 1e−80 | 98 |
| 709 | 8 | 700049271H1 | SATMON003 | g1532072 | BLASTN | 627 | 1e−79 | 93 |
| 710 | 8 | 700442065H1 | SATMON026 | g1532072 | BLASTN | 1043 | 1e−78 | 91 |
| 711 | 8 | 700244175H1 | SATMON010 | g1532072 | BLASTN | 1044 | 1e−78 | 90 |
| 712 | 8 | 700045296H1 | SATMON004 | g1532072 | BLASTN | 1041 | 1e−77 | 93 |
| 713 | 8 | 700578391H1 | SATMON031 | g1532072 | BLASTN | 624 | 1e−76 | 88 |
| 714 | 8 | 700346136H1 | SATMON021 | g1532072 | BLASTN | 751 | 1e−76 | 90 |
| 715 | 8 | 700457852H1 | SATMON029 | g1532072 | BLASTN | 777 | 1e−76 | 92 |
| 716 | 8 | 700570111H1 | SATMON030 | g1532072 | BLASTN | 814 | 1e−75 | 94 |
| 717 | 8 | LIB3066-030-Q1-K1-A12 | LIB3066 | g1532072 | BLASTN | 922 | 1e−75 | 94 |
| 718 | 8 | 700149657H1 | SATMON007 | g1532072 | BLASTN | 1012 | 1e−75 | 92 |
| 719 | 8 | LIB3060-043-Q1-K1-B4 | LIB3060 | g1532072 | BLASTN | 1013 | 1e−75 | 97 |
| 720 | 8 | 700156752H1 | SATMON012 | g1532072 | BLASTN | 1013 | 1e−75 | 98 |
| 721 | 8 | 700454114H1 | SATMON029 | g1532072 | BLASTN | 455 | 1e−74 | 93 |
| 722 | 8 | LIB143-053-Q1-E1-E8 | LIB143 | g1532072 | BLASTN | 672 | 1e−74 | 98 |
| 723 | 8 | 700029323H1 | SATMON003 | g1532072 | BLASTN | 996 | 1e−74 | 99 |
| 724 | 8 | 700156381H1 | SATMON007 | g1532072 | BLASTN | 1002 | 1e−74 | 97 |
| 725 | 8 | 700159603H2 | SATMON012 | g1532072 | BLASTN | 1003 | 1e−74 | 94 |
| 726 | 8 | LIB3060-035-Q1-K1-E5 | LIB3060 | g1532072 | BLASTN | 603 | 1e−72 | 94 |
| 727 | 8 | LIB3069-025-Q1-K1-E12 | LIB3069 | g1532072 | BLASTN | 734 | 1e−72 | 90 |
| 728 | 8 | 700166680H1 | SATMON013 | g1532072 | BLASTN | 971 | 1e−72 | 99 |
| 729 | 8 | 700171123H1 | SATMON013 | g1532072 | BLASTN | 973 | 1e−72 | 94 |
| 730 | 8 | LIB148-042-Q1-E1-G10 | LIB148 | g1532072 | BLASTN | 975 | 1e−72 | 100 |
| 731 | 8 | 700612951H1 | SATMON033 | g1532072 | BLASTN | 401 | 1e−71 | 96 |
| 732 | 8 | 700265213H1 | SATMON017 | g1532072 | BLASTN | 626 | 1e−71 | 92 |
| 733 | 8 | LIB189-030-Q1-E1-D11 | LIB189 | g1532072 | BLASTN | 740 | 1e−70 | 92 |
| 734 | 8 | 700212877H1 | SATMON016 | g1532072 | BLASTN | 918 | 1e−70 | 93 |
| 735 | 8 | 700161545H1 | SATMON012 | g1532072 | BLASTN | 621 | 1e−69 | 99 |
| 736 | 8 | 700021259H1 | SATMON001 | g1532072 | BLASTN | 940 | 1e−69 | 93 |
| 737 | 8 | LIB3079-015-Q1-K1-C7 | LIB3079 | g1532072 | BLASTN | 508 | 1e−68 | 96 |
| 738 | 8 | LIB3066-055-Q1-K1-F11 | LIB3066 | g1532072 | BLASTN | 832 | 1e−68 | 85 |
| 739 | 8 | 700166771H1 | SATMON013 | g1532072 | BLASTN | 922 | 1e−68 | 88 |
| 740 | 8 | LIB3066-003-Q1-K1-E6 | LIB3066 | g1532072 | BLASTN | 927 | 1e−68 | 86 |
| 741 | 8 | 700208131H1 | SATMON016 | g1532047 | BLASTN | 747 | 1e−66 | 85 |
| 742 | 8 | 700020688H1 | SATMON001 | g1532072 | BLASTN | 905 | 1e−66 | 90 |
| 743 | 8 | 700206405H1 | SATMON003 | g1532072 | BLASTN | 905 | 1e−66 | 100 |
| 744 | 8 | LIB3069-042-Q1-K1-C5 | LIB3069 | g1532072 | BLASTN | 891 | 1e−65 | 99 |
| 745 | 8 | 700353835H1 | SATMON024 | g1532072 | BLASTN | 896 | 1e−65 | 96 |
| 746 | 8 | 700471533H1 | SATMON025 | g1532072 | BLASTN | 496 | 1e−63 | 99 |
| 747 | 8 | 700165425H1 | SATMON013 | g1532072 | BLASTN | 850 | 1e−62 | 100 |

-continued

ADENOSYLMETHIONINE DECARBOXYLASE (EC 4.1.1.50)

| Seq No. | Cluster ID | CloneID | Library | NCBI gi | Method | Score | P-value | % Ident |
|---|---|---|---|---|---|---|---|---|
| 748 | 8 | LIB3069-054-Q1-K1-C4 | LIB3069 | g1532072 | BLASTN | 613 | 1e−60 | 87 |
| 749 | 8 | 700160896H1 | SATMON012 | g1532072 | BLASTN | 746 | 1e−60 | 95 |
| 750 | 8 | LIB3069-042-Q1-K1-A11 | LIB3069 | g1532072 | BLASTN | 840 | 1e−60 | 98 |
| 751 | 8 | 700466625H1 | SATMON025 | g1532072 | BLASTN | 635 | 1e−59 | 86 |
| 752 | 8 | 700571770H1 | SATMON030 | g1532072 | BLASTN | 820 | 1e−59 | 84 |
| 753 | 8 | LIB143-024-Q1-E1-D2 | LIB143 | g1532072 | BLASTN | 813 | 1e−58 | 95 |
| 754 | 8 | 700453677H1 | SATMON028 | g1532072 | BLASTN | 508 | 1e−57 | 92 |
| 755 | 8 | 700193979H1 | SATMON014 | g1532072 | BLASTN | 790 | 1e−57 | 100 |
| 756 | 8 | 700467828H1 | SATMON025 | g1532072 | BLASTN | 779 | 1e−56 | 96 |
| 757 | 8 | 700150072H1 | SATMON007 | g1532072 | BLASTN | 776 | 1e−55 | 99 |
| 758 | 8 | 700802869H1 | SATMON036 | g1532072 | BLASTN | 702 | 1e−54 | 95 |
| 759 | 8 | LIB148-051-Q1-E1-B12 | LIB148 | g1532072 | BLASTN | 421 | 1e−53 | 92 |
| 760 | 8 | 700075035H1 | SATMON007 | g1532072 | BLASTN | 506 | 1e−53 | 93 |
| 761 | 8 | 700471283H1 | SATMON025 | g1532072 | BLASTN | 742 | 1e−53 | 91 |
| 762 | 8 | 700166625H1 | SATMON013 | g1532072 | BLASTN | 748 | 1e−53 | 99 |
| 763 | 8 | 700019894H1 | SATMON001 | g1532072 | BLASTN | 643 | 1e−51 | 89 |
| 764 | 8 | 700204863H1 | SATMON003 | g1532072 | BLASTN | 721 | 1e−51 | 99 |
| 765 | 8 | 700431071H1 | SATMONN01 | g1532072 | BLASTN | 366 | 1e−50 | 94 |
| 766 | 8 | 700171582H1 | SATMON013 | g1532072 | BLASTN | 492 | 1e−50 | 99 |
| 767 | 8 | 700450579H1 | SATMON028 | g1532072 | BLASTN | 338 | 1e−49 | 97 |
| 768 | 8 | 700084149H1 | SATMON011 | g1532072 | BLASTN | 672 | 1e−47 | 98 |
| 769 | 8 | 700095070H1 | SATMON008 | g1532072 | BLASTN | 662 | 1e−46 | 98 |
| 770 | 8 | 700570827H1 | SATMON030 | g1532072 | BLASTN | 344 | 1e−44 | 83 |
| 771 | 8 | LIB3061-057-Q1-K1-G12 | LIB3061 | g1532072 | BLASTN | 378 | 1e−43 | 75 |
| 772 | 8 | 700194918H1 | SATMON014 | g1532072 | BLASTN | 626 | 1e−43 | 89 |
| 773 | 8 | 700378894H1 | SATMON020 | g1532072 | BLASTN | 495 | 1e−42 | 97 |
| 774 | 8 | 700468029H1 | SATMON025 | g1532072 | BLASTN | 616 | 1e−42 | 98 |
| 775 | 8 | LIB143-012-Q1-E1-H8 | LIB143 | g1532072 | BLASTN | 637 | 1e−42 | 98 |
| 776 | 8 | LIB3060-037-Q1-K1-H4 | LIB3060 | g1532072 | BLASTN | 638 | 1e−42 | 86 |
| 777 | 8 | 700433327H1 | SATMONN01 | g1532072 | BLASTN | 365 | 1e−41 | 86 |
| 778 | 8 | 700623611H1 | SATMON034 | g1532072 | BLASTN | 316 | 1e−39 | 95 |
| 779 | 8 | 700166123H1 | SATMON013 | g1532072 | BLASTN | 585 | 1e−39 | 100 |
| 780 | 8 | 700616273H1 | SATMON033 | g1532072 | BLASTN | 534 | 1e−38 | 98 |
| 781 | 8 | 700464702H1 | SATMON025 | g1532072 | BLASTN | 566 | 1e−38 | 99 |
| 782 | 8 | 700338809H1 | SATMON020 | g1532072 | BLASTN | 550 | 1e−37 | 100 |
| 783 | 8 | 700092622H1 | SATMON008 | g1532072 | BLASTN | 561 | 1e−37 | 99 |
| 784 | 8 | LIB3060-043-Q1-K1-A10 | LIB3060 | g1532072 | BLASTN | 352 | 1e−36 | 93 |
| 785 | 8 | 700265611H1 | SATMON017 | g1532072 | BLASTN | 548 | 1e−36 | 95 |
| 786 | 8 | 700100319H1 | SATMON009 | g1532072 | BLASTN | 552 | 1e−36 | 98 |
| 787 | 8 | 700092696H1 | SATMON008 | g1532072 | BLASTN | 552 | 1e−36 | 98 |
| 788 | 8 | 700076750H1 | SATMON007 | g1532072 | BLASTN | 526 | 1e−35 | 99 |
| 789 | 8 | 700082896H1 | SATMON011 | g1532072 | BLASTN | 526 | 1e−35 | 99 |
| 790 | 8 | 700075411H1 | SATMON007 | g1532072 | BLASTN | 319 | 1e−34 | 91 |
| 791 | 8 | 701178051H1 | SATMONN05 | g1532072 | BLASTN | 342 | 1e−34 | 94 |
| 792 | 8 | 700266358H1 | SATMON017 | g1532072 | BLASTN | 520 | 1e−34 | 95 |
| 793 | 8 | 700453981H1 | SATMON029 | g1532072 | BLASTN | 505 | 1e−33 | 96 |
| 794 | 8 | 700584238H1 | SATMON031 | g1532072 | BLASTN | 509 | 1e−33 | 91 |
| 795 | 8 | 700103871H1 | SATMON010 | g1532072 | BLASTN | 491 | 1e−32 | 99 |
| 796 | 8 | 700264460H1 | SATMON017 | g1532072 | BLASTN | 495 | 1e−32 | 95 |
| 797 | 8 | 700205122H1 | SATMON003 | g1532072 | BLASTN | 501 | 1e−32 | 99 |
| 798 | 8 | 700165768H1 | SATMON013 | g1532072 | BLASTN | 420 | 1e−31 | 98 |
| 799 | 8 | 700077179H1 | SATMON007 | g1532072 | BLASTN | 471 | 1e−30 | 98 |
| 800 | 8 | 700476654H1 | SATMON025 | g1532072 | BLASTN | 476 | 1e−30 | 98 |
| 801 | 8 | 700027374H1 | SATMON003 | g1532072 | BLASTN | 476 | 1e−30 | 98 |
| 802 | 8 | 700266994H1 | SATMON017 | g1532072 | BLASTN | 476 | 1e−30 | 98 |
| 803 | 8 | 700088193H1 | SATMON011 | g1532072 | BLASTN | 488 | 1e−30 | 97 |
| 804 | 8 | 700214511H1 | SATMON016 | g1532072 | BLASTN | 298 | 1e−29 | 93 |
| 805 | 8 | 700257186H1 | SATMON017 | g1532072 | BLASTN | 465 | 1e−29 | 95 |
| 806 | 8 | 700335814H1 | SATMON019 | g1532072 | BLASTN | 469 | 1e−29 | 93 |
| 807 | 8 | 700236166H1 | SATMON010 | g1532072 | BLASTN | 450 | 1e−28 | 95 |
| 808 | 8 | 700468243H1 | SATMON025 | g1532072 | BLASTN | 456 | 1e−28 | 98 |
| 809 | 8 | 700096327H1 | SATMON008 | g1532072 | BLASTN | 451 | 1e−27 | 98 |
| 810 | 8 | 700471139H1 | SATMON025 | g1532072 | BLASTN | 451 | 1e−27 | 98 |
| 811 | 8 | 700050420H1 | SATMON003 | g1532072 | BLASTN | 365 | 1e−26 | 92 |
| 812 | 8 | 700264846H1 | SATMON017 | g1532072 | BLASTN | 430 | 1e−25 | 94 |
| 813 | 8 | 700266803H1 | SATMON017 | g1532072 | BLASTN | 293 | 1e−24 | 75 |
| 814 | 8 | 700086134H1 | SATMON011 | g1532072 | BLASTN | 422 | 1e−24 | 97 |
| 815 | 8 | 700162001H1 | SATMON012 | g1532072 | BLASTN | 279 | 1e−23 | 96 |
| 816 | 8 | 700044825H1 | SATMON004 | g1532072 | BLASTN | 411 | 1e−23 | 98 |
| 817 | 8 | 700074679H1 | SATMON007 | g1532072 | BLASTN | 411 | 1e−23 | 98 |
| 818 | 8 | 700267694H1 | SATMON017 | g1532072 | BLASTN | 320 | 1e−22 | 92 |
| 819 | 8 | 700267990H1 | SATMON017 | g1532072 | BLASTN | 361 | 1e−22 | 99 |
| 820 | 8 | 700456715H1 | SATMON029 | g1532072 | BLASTN | 293 | 1e−21 | 97 |
| 821 | 8 | 700454806H1 | SATMON029 | g1532072 | BLASTN | 356 | 1e−21 | 98 |
| 822 | 8 | 700466812H1 | SATMON025 | g1532072 | BLASTN | 380 | 1e−21 | 95 |

ADENOSYLMETHIONINE DECARBOXYLASE (EC 4.1.1.50)

| Seq No. | Cluster ID | CloneID | Library | NCBI gi | Method | Score | P-value | % Ident |
|---|---|---|---|---|---|---|---|---|
| 823 | 8 | 700046476H1 | SATMON004 | g1532072 | BLASTN | 381 | 1e−21 | 97 |
| 824 | 8 | 700207160H1 | SATMON017 | g1532072 | BLASTN | 393 | 1e−21 | 96 |
| 825 | 8 | 700383037H1 | SATMON024 | g1532072 | BLASTN | 280 | 1e−20 | 98 |
| 826 | 8 | 700549660H1 | SATMON022 | g1532072 | BLASTN | 376 | 1e−20 | 97 |
| 827 | 8 | LIB3066-004-Q1-K1-G12 | LIB3066 | g1532072 | BLASTN | 379 | 1e−20 | 91 |
| 828 | 8 | 700801422H1 | SATMON036 | g1532072 | BLASTN | 321 | 1e−19 | 97 |
| 829 | 8 | 700045319H1 | SATMON004 | g1532072 | BLASTN | 336 | 1e−17 | 99 |
| 830 | 8 | 700046047H1 | SATMON004 | g1532072 | BLASTN | 336 | 1e−17 | 99 |
| 831 | 8 | 700264328H1 | SATMON017 | g1532072 | BLASTN | 339 | 1e−17 | 95 |
| 832 | 8 | 700083485H1 | SATMON011 | g1532072 | BLASTN | 341 | 1e−17 | 99 |
| 833 | 8 | 700461268H1 | SATMON033 | g1532072 | BLASTN | 342 | 1e−17 | 95 |
| 834 | 8 | 700053271H1 | SATMON008 | g1532072 | BLASTN | 311 | 1e−15 | 98 |
| 835 | 8 | 700215275H1 | SATMON016 | g1532072 | BLASTN | 321 | 1e−15 | 98 |
| 836 | 8 | 700623133H1 | SATMON034 | g1532072 | BLASTN | 275 | 1e−14 | 75 |
| 837 | 8 | 700454949H1 | SATMON029 | g1532072 | BLASTN | 280 | 1e−14 | 99 |
| 838 | 8 | 700440763H1 | SATMON026 | g1532072 | BLASTN | 307 | 1e−14 | 95 |
| 839 | 8 | LIB3068-022-Q1-K1-C4 | LIB3068 | g1532072 | BLASTN | 150 | 1e−12 | 94 |
| 840 | 8 | 700798849H1 | SATMON036 | g1532072 | BLASTN | 281 | 1e−12 | 98 |
| 841 | 8 | 700333057H1 | SATMON019 | g1532072 | BLASTN | 184 | 1e−11 | 91 |
| 842 | 8 | 700265786H1 | SATMON017 | g1532072 | BLASTN | 200 | 1e−11 | 90 |
| 843 | 8 | 700193030H1 | SATMON014 | g1532072 | BLASTN | 158 | 1e−9 | 94 |
| 844 | 8 | 700262964H1 | SATMON017 | g1532047 | BLASTN | 171 | 1e−9 | 81 |
| 845 | 8 | LIB3069-023-Q1-K1-B2 | LIB3069 | g1403043 | BLASTN | 195 | 1e−9 | 84 |
| 846 | 8 | 700474096H1 | SATMON025 | g1532072 | BLASTN | 199 | 1e−9 | 97 |
| 847 | 8 | 700028326H1 | SATMON003 | g1532072 | BLASTN | 151 | 1e−8 | 96 |
| 848 | 8011 | 700440327H1 | SATMON026 | g1532047 | BLASTN | 292 | 1e−14 | 85 |
| 849 | 851 | LIB3059-052-Q1-K1-E6 | LIB3059 | g1403043 | BLASTN | 1033 | 1e−85 | 75 |
| 850 | 851 | 700090958H1 | SATMON011 | g1532072 | BLASTN | 1044 | 1e−78 | 80 |
| 851 | 851 | 700224605H1 | SATMON011 | g1532072 | BLASTN | 850 | 1e−62 | 80 |
| 852 | 851 | 700551562H1 | SATMON022 | g1403043 | BLASTN | 374 | 1e−55 | 79 |
| 853 | 851 | 700153939H1 | SATMON007 | g1403043 | BLASTN | 772 | 1e−55 | 80 |
| 854 | 851 | 700469231H1 | SATMON025 | g1532072 | BLASTN | 560 | 1e−52 | 76 |
| 855 | 851 | 700349854H1 | SATMON023 | g1403043 | BLASTN | 669 | 1e−46 | 81 |
| 856 | 851 | 701169324H1 | SATMONN05 | g1403043 | BLASTN | 669 | 1e−46 | 78 |
| 857 | 851 | 700088319H1 | SATMON011 | g1532072 | BLASTN | 492 | 1e−30 | 78 |
| 2480 | -700998660 | 700998660H1 | SOYMON018 | g1531764 | BLASTN | 249 | 1e−29 | 90 |
| 2481 | -GM927 | LIB3028-005-Q1-B1-B4 | LIB3028 | g1421750 | BLASTN | 261 | 1e−10 | 80 |
| 2482 | 13379 | 700842514H1 | SOYMON020 | g1915980 | BLASTN | 575 | 1e−41 | 73 |
| 2483 | 13379 | 701042786H1 | SOYMON029 | g1421750 | BLASTN | 377 | 1e−20 | 80 |
| 2484 | 15556 | 701101584H1 | SOYMON028 | g1421750 | BLASTN | 526 | 1e−35 | 69 |
| 2485 | 15556 | 701099749H1 | SOYMON028 | g1155239 | BLASTN | 453 | 1e−27 | 72 |
| 2486 | 16 | LIB3051-018-Q1-E1-A7 | LIB3051 | g1421750 | BLASTN | 1146 | 1e−93 | 81 |
| 2487 | 16 | LIB3056-005-Q1-N1-E10 | LIB3056 | g1421750 | BLASTN | 944 | 1e−88 | 80 |
| 2488 | 16 | LIB3051-101-Q1-K1-C7 | LIB3051 | g1421750 | BLASTN | 1135 | 1e−85 | 80 |
| 2489 | 16 | LIB3056-001-Q1-B1-H12 | LIB3056 | g1421750 | BLASTN | 752 | 1e−82 | 81 |
| 2490 | 16 | 700661334H1 | SOYMON005 | g1421750 | BLASTN | 1092 | 1e−82 | 80 |
| 2491 | 16 | LIB3056-012-Q1-N1-B12 | LIB3056 | g1421750 | BLASTN | 1085 | 1e−81 | 80 |
| 2492 | 16 | LIB3055-011-Q1-N1-G2 | LIB3055 | g1421750 | BLASTN | 958 | 1e−78 | 79 |
| 2493 | 16 | 700663981H1 | SOYMON005 | g1421750 | BLASTN | 996 | 1e−74 | 82 |
| 2494 | 16 | 701109737H1 | SOYMON036 | g1421750 | BLASTN | 955 | 1e−70 | 83 |
| 2495 | 16 | 701130190H1 | SOYMON037 | g1421750 | BLASTN | 935 | 1e−69 | 81 |
| 2496 | 16 | 701003301H1 | SOYMON019 | g1421750 | BLASTN | 412 | 1e−68 | 82 |
| 2497 | 16 | 700894137H1 | SOYMON024 | g1421750 | BLASTN | 923 | 1e−68 | 84 |
| 2498 | 16 | 700980096H1 | SOYMON009 | g1421750 | BLASTN | 923 | 1e−68 | 81 |
| 2499 | 16 | 700942625H1 | SOYMON024 | g1421750 | BLASTN | 911 | 1e−67 | 80 |
| 2500 | 16 | 700829695H1 | SOYMON019 | g1421750 | BLASTN | 918 | 1e−67 | 84 |
| 2501 | 16 | 700662572H1 | SOYMON005 | g1421750 | BLASTN | 920 | 1e−67 | 84 |
| 2502 | 16 | 701127647H1 | SOYMON037 | g1421750 | BLASTN | 902 | 1e−66 | 84 |
| 2503 | 16 | 701014550H1 | SOYMON019 | g1421750 | BLASTN | 556 | 1e−65 | 81 |
| 2504 | 16 | LIB3051-043-Q1-K1-G3 | LIB3051 | g1421750 | BLASTN | 698 | 1e−65 | 82 |
| 2505 | 16 | 700730914H1 | SOYMON009 | g1421750 | BLASTN | 897 | 1e−65 | 84 |
| 2506 | 16 | 701052455H1 | SOYMON032 | g1421750 | BLASTN | 876 | 1e−64 | 81 |
| 2507 | 16 | LIB3051-074-Q1-K1-A7 | LIB3051 | g1421750 | BLASTN | 876 | 1e−64 | 75 |
| 2508 | 16 | 700874839H1 | SOYMON018 | g1421750 | BLASTN | 862 | 1e−63 | 82 |
| 2509 | 16 | 701005943H1 | SOYMON019 | g1421750 | BLASTN | 865 | 1e−63 | 82 |
| 2510 | 16 | 700663357H1 | SOYMON005 | g1421750 | BLASTN | 869 | 1e−63 | 82 |
| 2511 | 16 | 701042053H1 | SOYMON029 | g1421750 | BLASTN | 872 | 1e−63 | 81 |
| 2512 | 16 | 700971988H1 | SOYMON005 | g1421750 | BLASTN | 508 | 1e−61 | 82 |
| 2513 | 16 | 701010728H1 | SOYMON019 | g1421750 | BLASTN | 657 | 1e−61 | 81 |
| 2514 | 16 | 700987206H1 | SOYMON009 | g1421750 | BLASTN | 845 | 1e−61 | 83 |
| 2515 | 16 | 701126773H1 | SOYMON037 | g1421750 | BLASTN | 847 | 1e−61 | 79 |
| 2516 | 16 | 700764714H1 | SOYMON023 | g1421750 | BLASTN | 830 | 1e−60 | 81 |
| 2517 | 16 | 700974444H1 | SOYMON005 | g1421750 | BLASTN | 830 | 1e−60 | 81 |
| 2518 | 16 | 701118620H1 | SOYMON037 | g1421750 | BLASTN | 832 | 1e−60 | 75 |
| 2519 | 16 | 700729926H1 | SOYMON009 | g1421750 | BLASTN | 834 | 1e−60 | 79 |

ADENOSYLMETHIONINE DECARBOXYLASE (EC 4.1.1.50)

| Seq No. | Cluster ID | CloneID | Library | NCBI gi | Method | Score | P-value | % Ident |
|---|---|---|---|---|---|---|---|---|
| 2520 | 16 | 700945142H1 | SOYMON024 | g1421750 | BLASTN | 470 | 1e−59 | 84 |
| 2521 | 16 | 700867912H1 | SOYMON016 | g1421750 | BLASTN | 820 | 1e−59 | 82 |
| 2522 | 16 | 700746546H1 | SOYMON013 | g1421750 | BLASTN | 824 | 1e−59 | 78 |
| 2523 | 16 | 700873331H1 | SOYMON018 | g1421750 | BLASTN | 769 | 1e−58 | 82 |
| 2524 | 16 | 700738212H1 | SOYMON012 | g1421750 | BLASTN | 780 | 1e−56 | 83 |
| 2525 | 16 | 700830454H1 | SOYMON019 | g1421750 | BLASTN | 789 | 1e−56 | 81 |
| 2526 | 16 | 700726129H1 | SOYMON009 | g1421750 | BLASTN | 789 | 1e−56 | 81 |
| 2527 | 16 | 700996774H1 | SOYMON018 | g1421750 | BLASTN | 486 | 1e−55 | 81 |
| 2528 | 16 | 700746427H1 | SOYMON013 | g1421750 | BLASTN | 766 | 1e−55 | 77 |
| 2529 | 16 | 701123911H1 | SOYMON037 | g1421750 | BLASTN | 769 | 1e−55 | 76 |
| 2530 | 16 | 700745730H1 | SOYMON013 | g1421750 | BLASTN | 775 | 1e−55 | 76 |
| 2531 | 16 | 700900940H1 | SOYMON027 | g1421750 | BLASTN | 760 | 1e−54 | 78 |
| 2532 | 16 | 700846419H1 | SOYMON021 | g1421750 | BLASTN | 762 | 1e−54 | 78 |
| 2533 | 16 | 701203427H1 | SOYMON035 | g1421750 | BLASTN | 491 | 1e−53 | 84 |
| 2534 | 16 | LIB3051-074-Q1-K1-F5 | LIB3051 | g1421750 | BLASTN | 650 | 1e−53 | 75 |
| 2535 | 16 | 700747646H1 | SOYMON013 | g1421750 | BLASTN | 747 | 1e−53 | 77 |
| 2536 | 16 | 701049823H1 | SOYMON032 | g1421750 | BLASTN | 751 | 1e−53 | 77 |
| 2537 | 16 | 701049188H1 | SOYMON032 | g1421750 | BLASTN | 731 | 1e−52 | 75 |
| 2538 | 16 | 700875156H1 | SOYMON018 | g1421750 | BLASTN | 737 | 1e−52 | 78 |
| 2539 | 16 | 700864540H1 | SOYMON016 | g1421750 | BLASTN | 741 | 1e−52 | 81 |
| 2540 | 16 | 700682329H2 | SOYMON008 | g1421750 | BLASTN | 719 | 1e−51 | 76 |
| 2541 | 16 | 700846215H1 | SOYMON021 | g1421750 | BLASTN | 575 | 1e−50 | 82 |
| 2542 | 16 | 701101327H1 | SOYMON028 | g1421750 | BLASTN | 592 | 1e−50 | 77 |
| 2543 | 16 | LIB3055-011-Q1-N1-E7 | LIB3055 | g1421750 | BLASTN | 680 | 1e−50 | 80 |
| 2544 | 16 | 700848992H1 | SOYMON021 | g1421750 | BLASTN | 708 | 1e−50 | 76 |
| 2545 | 16 | 700966820H1 | SOYMON028 | g1421750 | BLASTN | 710 | 1e−50 | 75 |
| 2546 | 16 | 701051785H1 | SOYMON032 | g1421750 | BLASTN | 717 | 1e−50 | 75 |
| 2547 | 16 | 700681079H1 | SOYMON008 | g1917012 | BLASTN | 290 | 1e−49 | 77 |
| 2548 | 16 | 701138880H1 | SOYMON038 | g1421750 | BLASTN | 610 | 1e−49 | 78 |
| 2549 | 16 | 700872967H1 | SOYMON018 | g1421750 | BLASTN | 704 | 1e−49 | 75 |
| 2550 | 16 | 701119960H1 | SOYMON037 | g1421750 | BLASTN | 684 | 1e−48 | 81 |
| 2551 | 16 | 700873306H1 | SOYMON018 | g1421750 | BLASTN | 693 | 1e−48 | 83 |
| 2552 | 16 | 700751484H1 | SOYMON014 | g1421750 | BLASTN | 635 | 1e−47 | 82 |
| 2553 | 16 | 700958865H1 | SOYMON022 | g1421750 | BLASTN | 486 | 1e−46 | 82 |
| 2554 | 16 | 700872833H1 | SOYMON018 | g1421750 | BLASTN | 659 | 1e−46 | 84 |
| 2555 | 16 | 700871673H1 | SOYMON018 | g1421750 | BLASTN | 659 | 1e−46 | 84 |
| 2556 | 16 | 700872801H1 | SOYMON018 | g1421750 | BLASTN | 659 | 1e−46 | 84 |
| 2557 | 16 | 700847572H1 | SOYMON021 | g1421750 | BLASTN | 660 | 1e−46 | 75 |
| 2558 | 16 | 700728046H1 | SOYMON009 | g1421750 | BLASTN | 661 | 1e−46 | 84 |
| 2559 | 16 | 700894721H1 | SOYMON024 | g1421750 | BLASTN | 550 | 1e−43 | 84 |
| 2560 | 16 | 700730946H1 | SOYMON009 | g1421750 | BLASTN | 307 | 1e−42 | 77 |
| 2561 | 16 | 700727943H1 | SOYMON009 | g1421750 | BLASTN | 378 | 1e−42 | 79 |
| 2562 | 16 | 701101238H1 | SOYMON028 | g1421750 | BLASTN | 456 | 1e−42 | 92 |
| 2563 | 16 | 700758519H1 | SOYMON015 | g1421750 | BLASTN | 358 | 1e−41 | 77 |
| 2564 | 16 | 700740343H1 | SOYMON012 | g1531764 | BLASTN | 607 | 1e−41 | 72 |
| 2565 | 16 | 700848076H1 | SOYMON021 | g1531764 | BLASTN | 469 | 1e−40 | 89 |
| 2566 | 16 | LIB3051-080-Q1-K1-H7 | LIB3051 | g1531764 | BLASTN | 472 | 1e−38 | 90 |
| 2567 | 16 | 700955916H1 | SOYMON022 | g1531764 | BLASTN | 427 | 1e−37 | 90 |
| 2568 | 16 | 700873876H1 | SOYMON018 | g1421750 | BLASTN | 465 | 1e−37 | 80 |
| 2569 | 16 | 700746271H1 | SOYMON013 | g1421750 | BLASTN | 515 | 1e−37 | 80 |
| 2570 | 16 | 700662887H1 | SOYMON005 | g1421750 | BLASTN | 506 | 1e−35 | 82 |
| 2571 | 16 | 700983591H1 | SOYMON009 | g1421750 | BLASTN | 537 | 1e−35 | 82 |
| 2572 | 16 | 700752343H1 | SOYMON014 | g1421750 | BLASTN | 488 | 1e−34 | 73 |
| 2573 | 16 | 700901973H1 | SOYMON027 | g1421750 | BLASTN | 490 | 1e−34 | 82 |
| 2574 | 16 | LIB3053-013-Q1-N1-B11 | LIB3053 | g1421750 | BLASTN | 522 | 1e−34 | 75 |
| 2575 | 16 | 700988481H1 | SOYMON009 | g1421750 | BLASTN | 506 | 1e−33 | 78 |
| 2576 | 16 | LIB3051-078-Q1-K1-C12 | LIB3051 | g1421750 | BLASTN | 302 | 1e−32 | 75 |
| 2577 | 16 | 700985640H1 | SOYMON009 | g1421750 | BLASTN | 449 | 1e−30 | 86 |
| 2578 | 16 | 701127038H1 | SOYMON037 | g1421750 | BLASTN | 467 | 1e−30 | 67 |
| 2579 | 16 | 700898677H1 | SOYMON027 | g1531764 | BLASTN | 474 | 1e−30 | 89 |
| 2580 | 16 | 700742260H1 | SOYMON012 | g1421750 | BLASTN | 476 | 1e−30 | 70 |
| 2581 | 16 | 701103203H1 | SOYMON028 | g1421750 | BLASTN | 287 | 1e−27 | 81 |
| 2582 | 16 | 700897144H1 | SOYMON027 | g1421750 | BLASTN | 264 | 1e−26 | 75 |
| 2583 | 16 | 700832039H1 | SOYMON019 | g1421750 | BLASTN | 390 | 1e−26 | 82 |
| 2584 | 16 | 700743311H1 | SOYMON012 | g1421750 | BLASTN | 429 | 1e−26 | 87 |
| 2585 | 16 | LIB3040-044-Q1-E1-B8 | LIB3040 | g1421750 | BLASTN | 282 | 1e−25 | 92 |
| 2586 | 16 | LIB3051-024-Q1-K1-C4 | LIB3051 | g2394382 | BLASTX | 110 | 1e−24 | 95 |
| 2587 | 16 | 701011765H1 | SOYMON019 | g1421750 | BLASTN | 383 | 1e−21 | 76 |
| 2588 | 16 | 700893428H1 | SOYMON024 | g1421752 | BLASTX | 106 | 1e−20 | 82 |
| 2589 | 16 | 700996204H1 | SOYMON018 | g1421750 | BLASTN | 288 | 1e−20 | 75 |
| 2590 | 16 | LIB3049-028-Q1-E1-C6 | LIB3049 | g1421750 | BLASTN | 230 | 1e−19 | 90 |
| 2591 | 16 | 701103628H1 | SOYMON028 | g1421750 | BLASTN | 277 | 1e−18 | 73 |
| 2592 | 16 | 700972636H1 | SOYMON005 | g1421750 | BLASTN | 286 | 1e−16 | 73 |
| 2593 | 16 | 700875417H1 | SOYMON018 | g1421750 | BLASTN | 209 | 1e−15 | 75 |
| 2594 | 16 | 701207702H1 | SOYMON035 | g1421752 | BLASTX | 153 | 1e−14 | 83 |

ADENOSYLMETHIONINE DECARBOXYLASE (EC 4.1.1.50)

| Seq No. | Cluster ID | CloneID | Library | NCBI gi | Method | Score | P-value | % Ident |
|---|---|---|---|---|---|---|---|---|
| 2595 | 16 | 701054556H1 | SOYMON032 | g1421750 | BLASTN | 230 | 1e−14 | 75 |
| 2596 | 16 | 701046407H1 | SOYMON032 | g1421750 | BLASTN | 230 | 1e−14 | 75 |
| 2597 | 16 | 701117634H1 | SOYMON037 | g1421750 | BLASTN | 230 | 1e−14 | 74 |
| 2598 | 16 | 701127714H1 | SOYMON037 | g1421750 | BLASTN | 230 | 1e−14 | 75 |
| 2599 | 16 | 700663239H1 | SOYMON005 | g1421750 | BLASTN | 210 | 1e−13 | 74 |
| 2600 | 16 | 700738510H1 | SOYMON012 | g1421750 | BLASTN | 212 | 1e−13 | 72 |
| 2601 | 16 | 700943559H1 | SOYMON024 | g1421750 | BLASTN | 215 | 1e−13 | 71 |
| 2602 | 16 | 700666278H1 | SOYMON005 | g1421750 | BLASTN | 290 | 1e−13 | 93 |
| 2603 | 16 | 700663144H1 | SOYMON005 | g1421750 | BLASTN | 204 | 1e−12 | 74 |
| 2604 | 16 | 700684147H1 | SOYMON008 | g1421750 | BLASTN | 278 | 1e−12 | 89 |
| 2605 | 16 | 700953076H1 | SOYMON022 | g1421750 | BLASTN | 285 | 1e−12 | 92 |
| 2606 | 16 | 701099931H1 | SOYMON028 | g1421750 | BLASTN | 202 | 1e−11 | 72 |
| 2607 | 16 | 701058910H1 | SOYMON033 | g1421750 | BLASTN | 216 | 1e−11 | 74 |
| 2608 | 16 | 700754949H1 | SOYMON014 | g1421750 | BLASTN | 266 | 1e−11 | 89 |
| 2609 | 16 | 700562967H1 | SOYMON002 | g1421750 | BLASTN | 266 | 1e−11 | 82 |
| 2610 | 16 | 701012790H1 | SOYMON019 | g1421750 | BLASTN | 251 | 1e−10 | 89 |
| 2611 | 16 | 701101739H1 | SOYMON028 | g1421750 | BLASTN | 260 | 1e−10 | 82 |
| 2612 | 16 | 701118211H1 | SOYMON037 | g1490554 | BLASTX | 97 | 1e−9 | 47 |
| 2613 | 16 | 700844394H1 | SOYMON021 | g1917013 | BLASTX | 116 | 1e−9 | 85 |
| 2614 | 16 | 701048560H1 | SOYMON032 | g1421750 | BLASTN | 198 | 1e−9 | 79 |
| 2615 | 16 | 701062373H1 | SOYMON033 | g1421750 | BLASTN | 203 | 1e−9 | 71 |
| 2616 | 16 | 701120496H1 | SOYMON037 | g1421750 | BLASTN | 230 | 1e−9 | 82 |
| 2617 | 16 | 701049680H1 | SOYMON032 | g1421750 | BLASTN | 177 | 1e−8 | 70 |
| 2618 | 16 | 700748760H1 | SOYMON013 | g1421750 | BLASTN | 230 | 1e−8 | 91 |
| 2619 | 16 | 700889482H1 | SOYMON024 | g1421750 | BLASTN | 235 | 1e−8 | 91 |
| 2620 | 16 | 700725013H1 | SOYMON009 | g1421750 | BLASTN | 239 | 1e−8 | 85 |
| 2621 | 16048 | LIB3028-004-Q1-B1-E2 | LIB3028 | g1421750 | BLASTN | 879 | 1e−64 | 68 |
| 2622 | 16048 | 700761667H1 | SOYMON015 | g1421750 | BLASTN | 528 | 1e−35 | 71 |
| 2623 | 16048 | 700958003H1 | SOYMON022 | g1421750 | BLASTN | 428 | 1e−26 | 78 |

ASPARTATE KINASE (EC 2.7.2.4)

| Seq No. | Cluster ID | CloneID | Library | NCBI gi | Method | Score | P-value | % Ident |
|---|---|---|---|---|---|---|---|---|
| 858 | −700018870 | 700018870H1 | SATMON001 | g500850 | BLASTN | 1095 | 1e−82 | 100 |
| 859 | −700085903 | 700085903H1 | SATMON011 | g500852 | BLASTN | 1606 | 1e−124 | 99 |
| 860 | −700086169 | 700086169H1 | SATMON011 | g500852 | BLASTN | 559 | 1e−94 | 92 |
| 861 | −700096679 | 700096679H1 | SATMON008 | g500850 | BLASTN | 1131 | 1e−85 | 99 |
| 862 | −700096794 | 700096794H1 | SATMON008 | g500850 | BLASTN | 1515 | 1e−117 | 100 |
| 863 | −700106390 | 700106390H1 | SATMON010 | g2243115 | BLASTN | 544 | 1e−51 | 72 |
| 864 | −700168286 | 700168286H1 | SATMON013 | g2243115 | BLASTN | 519 | 1e−34 | 72 |
| 865 | −700171363 | 700171363H1 | SATMON013 | g500850 | BLASTN | 1085 | 1e−81 | 94 |
| 866 | −700194781 | 700194781H1 | SATMON014 | g2257742 | BLASTN | 635 | 1e−44 | 79 |
| 867 | −700213839 | 700213839H1 | SATMON016 | g500850 | BLASTN | 664 | 1e−75 | 94 |
| 868 | −700219756 | 700219756H1 | SATMON011 | g500850 | BLASTN | 1359 | 1e−104 | 99 |
| 869 | −700258808 | 700258808H1 | SATMON017 | g500850 | BLASTN | 630 | 1e−85 | 96 |
| 870 | −700263439 | 700263439H1 | SATMON017 | g2243115 | BLASTN | 448 | 1e−43 | 76 |
| 871 | −700266615 | 700266615H1 | SATMON017 | g2243116 | BLASTX | 179 | 1e−17 | 73 |
| 872 | −700342655 | 700342655H1 | SATMON021 | g2257743 | BLASTX | 213 | 1e−22 | 82 |
| 873 | −700343285 | 700343285H1 | SATMON021 | g2257742 | BLASTN | 437 | 1e−25 | 66 |
| 874 | −700467533 | 700467533H1 | SATMON025 | g2243115 | BLASTN | 439 | 1e−26 | 79 |
| 875 | −700548678 | 700548678H1 | SATMON022 | g147979 | BLASTX | 147 | 1e−13 | 62 |
| 876 | −700613618 | 700613618H1 | SATMON033 | g500850 | BLASTN | 965 | 1e−81 | 98 |
| 877 | −L30691987 | LIB3069-018-Q1-K1-A3 | LIB3069 | g2243115 | BLASTN | 266 | 1e−10 | 57 |
| 878 | 12201 | 700457103H1 | SATMON029 | g2257742 | BLASTN | 789 | 1e−56 | 76 |
| 879 | 12201 | 700457111H1 | SATMON029 | g2243115 | BLASTN | 513 | 1e−33 | 76 |
| 880 | 12931 | 700380864H1 | SATMON023 | g500852 | BLASTN | 1450 | 1e−111 | 95 |
| 881 | 12931 | 700105610H1 | SATMON010 | g500852 | BLASTN | 1046 | 1e−105 | 95 |
| 882 | 12931 | 700380848H1 | SATMON023 | g500852 | BLASTN | 1193 | 1e−96 | 95 |
| 883 | 12931 | 700205392H1 | SATMON003 | g500852 | BLASTN | 1065 | 1e−94 | 93 |
| 884 | 12931 | 700552314H1 | SATMON022 | g500852 | BLASTN | 908 | 1e−86 | 90 |
| 885 | 12931 | 700551915H1 | SATMON022 | g500852 | BLASTN | 1090 | 1e−81 | 90 |
| 886 | 16037 | 700344509H1 | SATMON021 | g500852 | BLASTN | 1184 | 1e−89 | 92 |
| 887 | 16037 | 700345170H1 | SATMON021 | g500852 | BLASTN | 600 | 1e−58 | 85 |
| 888 | 16157 | 700212607H1 | SATMON016 | g2243115 | BLASTN | 914 | 1e−67 | 76 |
| 889 | 16157 | 700094809H1 | SATMON008 | g2243116 | BLASTX | 144 | 1e−12 | 84 |
| 890 | 19231 | 700091761H1 | SATMON011 | g500850 | BLASTN | 1358 | 1e−104 | 98 |
| 891 | 19231 | 700612568H1 | SATMON033 | g500850 | BLASTN | 1137 | 1e−102 | 99 |
| 892 | 22303 | 700553291H1 | SATMON022 | g2243115 | BLASTN | 644 | 1e−44 | 70 |

ASPARTATE KINASE (EC 2.7.2.4)

| Seq No. | Cluster ID | CloneID | Library | NCBI gi | Method | Score | P-value | % Ident |
|---|---|---|---|---|---|---|---|---|
| 893 | 22303 | 700553382H1 | SATMON022 | g2243115 | BLASTN | 418 | 1e–39 | 70 |
| 894 | 28000 | LIB143-061-Q1-E1-C7 | LIB143 | g2243115 | BLASTN | 1132 | 1e–85 | 75 |
| 895 | 28000 | 700474110H1 | SATMON025 | g2243115 | BLASTN | 509 | 1e–33 | 75 |
| 896 | 30401 | 700620948H1 | SATMON034 | g500852 | BLASTN | 327 | 1e–30 | 88 |
| 897 | 32907 | LIB143-038-Q1-E1-B11 | LIB143 | g500850 | BLASTN | 1864 | 1e–146 | 96 |
| 898 | 32907 | 700096779H1 | SATMON008 | g500850 | BLASTN | 1490 | 1e–115 | 97 |
| 899 | 5616 | 700346488H1 | SATMON021 | g2243115 | BLASTN | 664 | 1e–46 | 71 |
| 900 | 5616 | 700196138H1 | SATMON014 | g2243115 | BLASTN | 630 | 1e–43 | 74 |
| 2624 | -700556108 | 700556108H1 | SOYMON001 | g2243115 | BLASTN | 700 | 1e–49 | 74 |
| 2625 | -700663367 | 700663367H1 | SOYMON005 | g2243115 | BLASTN | 737 | 1e–52 | 77 |
| 2626 | -700733301 | 700733301H1 | SOYMON010 | g2243115 | BLASTN | 751 | 1e–53 | 78 |
| 2627 | -700747979 | 700747979H1 | SOYMON013 | g2257742 | BLASTN | 449 | 1e–27 | 70 |
| 2628 | -700832664 | 700832664H1 | SOYMON019 | g167547 | BLASTN | 322 | 1e–44 | 78 |
| 2629 | -700843925 | 700843925H1 | SOYMON021 | g167547 | BLASTN | 616 | 1e–42 | 71 |
| 2630 | -700888516 | 700888516H1 | SOYMON024 | g464225 | BLASTX | 193 | 1e–19 | 78 |
| 2631 | -700892002 | 700892002H1 | SOYMON024 | g2243115 | BLASTN | 363 | 1e–21 | 79 |
| 2632 | -700959057 | 700959057H1 | SOYMON022 | g2257742 | BLASTN | 497 | 1e–32 | 72 |
| 2633 | -700971891 | 700971891H1 | SOYMON005 | g167547 | BLASTN | 699 | 1e–49 | 74 |
| 2634 | -700984812 | 700984812H1 | SOYMON009 | g2257742 | BLASTN | 801 | 1e–57 | 77 |
| 2635 | -701069254 | 701069254H1 | SOYMON034 | g2243115 | BLASTN | 260 | 1e–23 | 75 |
| 2636 | -701120341 | 701120341H1 | SOYMON037 | g2243115 | BLASTN | 567 | 1e–38 | 77 |
| 2637 | -GM35173 | LIB3051-037-Q1-K1-B9 | LIB3051 | g2970554 | BLASTN | 193 | 1e–11 | 83 |
| 2638 | 15020 | 700557507H1 | SOYMON001 | g167547 | BLASTN | 914 | 1e–67 | 79 |
| 2639 | 15020 | 700666142H1 | SOYMON005 | g1107460 | BLASTN | 767 | 1e–55 | 77 |
| 2640 | 18237 | 700797368H1 | SOYMON017 | g2257742 | BLASTN | 819 | 1e–59 | 81 |
| 2641 | 18237 | 700797360H1 | SOYMON017 | g2257742 | BLASTN | 809 | 1e–58 | 84 |
| 2642 | 19332 | LIB3056-004-Q1-N1-D5 | LIB3056 | g2243115 | BLASTN | 1118 | 1e–84 | 74 |
| 2643 | 19332 | 700786255H2 | SOYMON011 | g2257742 | BLASTN | 626 | 1e–43 | 72 |
| 2644 | 19332 | 700684751H1 | SOYMON008 | g2257742 | BLASTN | 583 | 1e–39 | 73 |
| 2645 | 21954 | 701100440H1 | SOYMON028 | g167547 | BLASTN | 835 | 1e–60 | 78 |
| 2646 | 21954 | 701059173H1 | SOYMON033 | g167547 | BLASTN | 719 | 1e–51 | 75 |
| 2647 | 26336 | 701003103H1 | SOYMON019 | g2243115 | BLASTN | 877 | 1e–64 | 79 |
| 2648 | 26336 | 700976874H1 | SOYMON009 | g2243115 | BLASTN | 880 | 1e–64 | 79 |

ASPARTATE-SEMIALDEHYDE DEHYDROGENASE (EC 1.2.1.11)

| Seq No. | Cluster ID | CloneID | Library | NCBI gi | Method | Score | P-value | % Ident |
|---|---|---|---|---|---|---|---|---|
| 901 | -700439614 | 700439614H1 | SATMON026 | g2314350 | BLASTX | 107 | 1e–13 | 52 |
| 902 | -701183695 | 701183695H1 | SATMONN06 | g289910 | BLASTX | 150 | 1e–13 | 69 |
| 903 | -L1487398 | LIB148-064-Q1-E1-D10 | LIB148 | g1749466 | BLASTX | 178 | 1e–33 | 55 |
| 904 | -L30622830 | LIB3062-028-Q1-K1-A8 | LIB3062 | g1085109 | BLASTX | 108 | 1e–40 | 48 |
| 2649 | -700756763 | 700756763H1 | SOYMON014 | g1359593 | BLASTX | 71 | 1e–8 | 52 |
| 2650 | -700830054 | 700830054H1 | SOYMON019 | g142828 | BLASTX | 87 | 1e–10 | 41 |
| 2651 | -701105617 | 701105617H1 | SOYMON036 | g142828 | BLASTX | 215 | 1e–22 | 57 |
| 2652 | -GM8539 | LIB3039-047-Q1-E1-C6 | LIB3039 | g142828 | BLASTX | 188 | 1e–35 | 50 |
| 2653 | 30187 | LIB3049-001-Q1-E1-F2 | LIB3049 | g1359593 | BLASTX | 136 | 1e–26 | 54 |
| 2654 | 30187 | 700556105H1 | SOYMON001 | g1359593 | BLASTX | 132 | 1e–11 | 56 |

O-SUCCINYLHOMOSERINE (THIOL)-LYASE (EC 4.2.99.9)

| Seq No. | Cluster ID | CloneID | Library | NCBI gi | Method | Score | P-value | % Ident |
|---|---|---|---|---|---|---|---|---|
| 905 | -700049526 | 700049526H1 | SATMON003 | g2198852 | BLASTN | 251 | 1e–9 | 76 |
| 906 | -700086788 | 700086788H1 | SATMON011 | g2198850 | BLASTN | 631 | 1e–61 | 88 |
| 907 | -700460589 | 700460589H1 | SATMON030 | g2198850 | BLASTN | 251 | 1e–32 | 83 |
| 908 | -700577561 | 700577561H1 | SATMON031 | g2198852 | BLASTN | 207 | 1e–15 | 82 |
| 909 | -700579840 | 700579840H1 | SATMON031 | g2198852 | BLASTN | 216 | 1e–12 | 94 |
| 910 | -700616013 | 700616013H1 | SATMON033 | g2198852 | BLASTN | 278 | 1e–39 | 81 |
| 911 | -L1892785 | LIB189-011-Q1-E1-A10 | LIB189 | g2198852 | BLASTN | 311 | 1e–14 | 82 |
| 912 | -L30594402 | LIB3059-042-Q1-K1-E11 | LIB3059 | g2198852 | BLASTN | 489 | 1e–40 | 84 |
| 913 | -L30604293 | LIB3060-028-Q1-K1-E7 | LIB3060 | g2198852 | BLASTN | 380 | 1e–20 | 83 |
| 914 | -L30693289 | LIB3069-016-Q1-K1-G10 | LIB3069 | g2198852 | BLASTN | 197 | 1e–10 | 79 |

-continued

O-SUCCINYLHOMOSERINE (THIOL)-LYASE (EC 4.2.99.9)

| Seq No. | Cluster ID | CloneID | Library | NCBI gi | Method | Score | P-value | % Ident |
|---|---|---|---|---|---|---|---|---|
| 915 | 10571 | 700224881H1 | SATMON011 | g2198852 | BLASTN | 319 | 1e−15 | 75 |
| 916 | 10801 | 700429049H1 | SATMONN01 | g2198852 | BLASTN | 210 | 1e−16 | 82 |
| 917 | 10801 | 700167813H1 | SATMON013 | g2198852 | BLASTN | 200 | 1e−15 | 82 |
| 918 | 10801 | 700074027H1 | SATMON007 | g2198852 | BLASTN | 178 | 1e−11 | 80 |
| 919 | 16379 | LIB3061-035-Q1-K1-B6 | LIB3061 | g2198850 | BLASTN | 2184 | 1e−173 | 99 |
| 920 | 16379 | 700259309H1 | SATMON017 | g2198850 | BLASTN | 1259 | 1e−108 | 92 |
| 921 | 16379 | 700051696H1 | SATMON003 | g2198850 | BLASTN | 1392 | 1e−107 | 96 |
| 922 | 16379 | 700239553H1 | SATMON010 | g2198850 | BLASTN | 1265 | 1e−96 | 96 |
| 923 | 16379 | 700042846H1 | SATMON004 | g2198850 | BLASTN | 1208 | 1e−91 | 95 |
| 924 | 16379 | 700092741H1 | SATMON008 | g2198850 | BLASTN | 1042 | 1e−89 | 95 |
| 925 | 16379 | LIB3061-017-Q1-K1-D7 | LIB3061 | g2198850 | BLASTN | 1183 | 1e−89 | 99 |
| 926 | 16379 | 700206765H1 | SATMON003 | g2198850 | BLASTN | 1095 | 1e−82 | 81 |
| 927 | 16379 | 700150281H1 | SATMON007 | g2198850 | BLASTN | 1024 | 1e−76 | 94 |
| 928 | 16379 | 700165862H1 | SATMON013 | g2198850 | BLASTN | 948 | 1e−75 | 94 |
| 929 | 2221 | LIB3060-017-Q1-K1-B10 | LIB3060 | g2198850 | BLASTN | 1819 | 1e−161 | 99 |
| 930 | 2221 | LIB84-006-Q1-E1-F3 | LIB84 | g2198852 | BLASTN | 1615 | 1e−153 | 97 |
| 931 | 2221 | 700575334H1 | SATMON030 | g2198850 | BLASTN | 1570 | 1e−124 | 99 |
| 932 | 2221 | 700206250H1 | SATMON003 | g2198850 | BLASTN | 1515 | 1e−117 | 100 |
| 933 | 2221 | 700095073H1 | SATMON008 | g2198852 | BLASTN | 1490 | 1e−115 | 100 |
| 934 | 2221 | 700571230H1 | SATMON030 | g2198850 | BLASTN | 1355 | 1e−114 | 93 |
| 935 | 2221 | 700157358H1 | SATMON012 | g2198850 | BLASTN | 1370 | 1e−105 | 100 |
| 936 | 2221 | 700379811H1 | SATMON021 | g2198850 | BLASTN | 1345 | 1e−103 | 93 |
| 937 | 2221 | 700041570H1 | SATMON004 | g2198850 | BLASTN | 1325 | 1e−101 | 100 |
| 938 | 2221 | 700104063H1 | SATMON010 | g2198850 | BLASTN | 1157 | 1e−95 | 90 |
| 939 | 2221 | 700378265H1 | SATMON019 | g2198850 | BLASTN | 771 | 1e−94 | 99 |
| 940 | 2221 | 700235329H1 | SATMON010 | g2198850 | BLASTN | 1234 | 1e−94 | 93 |
| 941 | 2221 | LIB3068-057-Q1-K1-D1 | LIB3068 | g2198852 | BLASTN | 1209 | 1e−91 | 94 |
| 942 | 2221 | 700159158H1 | SATMON012 | g2198850 | BLASTN | 1174 | 1e−89 | 94 |
| 943 | 2221 | 700580854H1 | SATMON031 | g2198850 | BLASTN | 754 | 1e−86 | 92 |
| 944 | 2221 | 700623409H1 | SATMON034 | g2198850 | BLASTN | 910 | 1e−84 | 96 |
| 945 | 2221 | 701164706H1 | SATMONN04 | g2198852 | BLASTN | 577 | 1e−83 | 94 |
| 946 | 2221 | 700164719H1 | SATMON013 | g2198852 | BLASTN | 831 | 1e−83 | 99 |
| 947 | 2221 | 700158146H1 | SATMON012 | g2198850 | BLASTN | 1100 | 1e−82 | 93 |
| 948 | 2221 | 700203970H1 | SATMON003 | g2198852 | BLASTN | 996 | 1e−80 | 99 |
| 949 | 2221 | 700158313H1 | SATMON012 | g2198850 | BLASTN | 1036 | 1e−77 | 93 |
| 950 | 2221 | 700425211H1 | SATMONN01 | g2198852 | BLASTN | 485 | 1e−61 | 96 |
| 951 | 2221 | 700167764H1 | SATMON013 | g2198850 | BLASTN | 793 | 1e−57 | 93 |
| 952 | 23788 | 700102780H1 | SATMON010 | g2198852 | BLASTN | 1131 | 1e−104 | 99 |
| 953 | 23788 | 701167458H1 | SATMONN05 | g2198852 | BLASTN | 1069 | 1e−90 | 93 |
| 2655 | -700900206 | 700900206H1 | SOYMON027 | g1742961 | BLASTX | 215 | 1e−24 | 78 |
| 2656 | -GM40351 | LIB3051-114-Q1-K1-H12 | LIB3051 | g2198851 | BLASTX | 122 | 1e−25 | 96 |
| 2657 | 12502 | 701101592H1 | SOYMON028 | g146846 | BLASTX | 103 | 1e−18 | 44 |
| 2658 | 12502 | 701106834H1 | SOYMON036 | g146846 | BLASTX | 103 | 1e−18 | 44 |
| 2659 | 13820 | LIB3055-003-Q1-N1-F12 | LIB3055 | g3202028 | BLASTX | 193 | 1e−35 | 94 |
| 2660 | 8119 | 700989656H1 | SOYMON011 | g1742960 | BLASTN | 815 | 1e−59 | 79 |

CYSTATHIONINE β-LYASE (EC 4.4.1.8)

| Seq No. | Cluster ID | CloneID | Library | NCBI gi | Method | Score | P-value | % Ident |
|---|---|---|---|---|---|---|---|---|
| 954 | -700155172 | 700155172H1 | SATMON007 | g704397 | BLASTX | 361 | 1e−43 | 78 |
| 955 | -L362943 | LIB36-013-Q1-E1-G10 | LIB36 | g704396 | BLASTN | 818 | 1e−59 | 75 |
| 956 | 19856 | 700240664H1 | SATMON010 | g704396 | BLASTN | 496 | 1e−31 | 69 |
| 957 | 19856 | 700572496H1 | SATMON030 | g704396 | BLASTN | 446 | 1e−26 | 68 |
| 958 | 22960 | 701170964H1 | SATMONN05 | g704396 | BLASTN | 778 | 1e−56 | 78 |
| 959 | 22960 | LIB3061-002-Q1-K2-F9 | LIB3061 | g704396 | BLASTN | 765 | 1e−53 | 77 |
| 960 | 22960 | 701172780H2 | SATMONN05 | g704396 | BLASTN | 686 | 1e−48 | 73 |
| 961 | 22960 | 700578571H1 | SATMON031 | g704397 | BLASTX | 222 | 1e−23 | 89 |
| 962 | 30752 | LIB3078-055-Q1-K1-C8 | LIB3078 | g704396 | BLASTN | 747 | 1e−51 | 71 |
| 963 | 30752 | 700086603H1 | SATMON011 | g704397 | BLASTX | 192 | 1e−18 | 64 |
| 2661 | -701001147 | 701001147H1 | SOYMON018 | g704396 | BLASTN | 847 | 1e−61 | 78 |
| 2662 | 18602 | 700566066H1 | SOYMON002 | g704396 | BLASTN | 751 | 1e−57 | 79 |
| 2663 | 18602 | 700890955H1 | SOYMON024 | g704396 | BLASTN | 698 | 1e−49 | 77 |
| 2664 | 18602 | 700896865H1 | SOYMON027 | g704396 | BLASTN | 682 | 1e−48 | 77 |
| 2665 | 5144 | LIB3050-006-Q1-E1-A9 | LIB3050 | g1399263 | BLASTX | 96 | 1e−31 | 41 |

5-METHYLTETRAHYDROPTEROYLTRIGLUTAMATE - HOMOCYSTEINE S-METHYLTRANSFERASE
(EC 2.1.1.14)

| Seq No. | Cluster ID | CloneID | Library | NCBI gi | Method | Score | P-value | % Ident |
|---|---|---|---|---|---|---|---|---|
| 964 | -700212217 | 700212217H1 | SATMON016 | g886471 | BLASTX | 151 | 1e-16 | 93 |
| 965 | -700333966 | 700333966H1 | SATMON019 | g886470 | BLASTN | 370 | 1e-23 | 66 |
| 966 | -700377403 | 700377403H1 | SATMON019 | g2738247 | BLASTN | 305 | 1e-26 | 80 |
| 967 | -700571893 | 700571893H1 | SATMON030 | g974781 | BLASTN | 262 | 1e-20 | 80 |
| 968 | -701165656 | 701165656H1 | SATMONN04 | g2738247 | BLASTN | 450 | 1e-50 | 73 |
| 969 | -L30622954 | LIB3062-030-Q1-K1-C9 | LIB3062 | g886470 | BLASTN | 366 | 1e-26 | 81 |
| 970 | -L30662004 | LIB3066-026-Q1-K1-F1 | LIB3066 | g2738248 | BLASTX | 140 | 1e-28 | 77 |
| 971 | -L30671450 | LIB3067-001-Q1-K1-C6 | LIB3067 | g2738247 | BLASTN | 553 | 1e-46 | 69 |
| 972 | -L30694410 | LIB3069-057-Q1-K1-B4 | LIB3069 | g886470 | BLASTN | 447 | 1e-26 | 67 |
| 973 | 1 | 700452404H1 | SATMON028 | g453939 | BLASTN | 59 | 1e-17 | 94 |
| 974 | 13513 | 700049012H1 | SATMON003 | g1814402 | BLASTN | 1006 | 1e-74 | 81 |
| 975 | 13513 | 700086058H1 | SATMON011 | g1814402 | BLASTN | 982 | 1e-72 | 81 |
| 976 | 13513 | 700235814H1 | SATMON010 | g1814402 | BLASTN | 890 | 1e-65 | 79 |
| 977 | 13513 | 700170015H1 | SATMON013 | g1814402 | BLASTN | 578 | 1e-39 | 78 |
| 978 | 3835 | 700093161H1 | SATMON008 | g974781 | BLASTN | 858 | 1e-62 | 76 |
| 979 | 3835 | 700223321H1 | SATMON011 | g974781 | BLASTN | 836 | 1e-60 | 80 |
| 980 | 3835 | 700454003H1 | SATMON029 | g974781 | BLASTN | 823 | 1e-59 | 82 |
| 981 | 3835 | 700238925H1 | SATMON010 | g2738247 | BLASTN | 733 | 1e-55 | 74 |
| 982 | 3835 | 700075142H1 | SATMON007 | g2738247 | BLASTN | 569 | 1e-52 | 73 |
| 983 | 3835 | 700151969H1 | SATMON007 | g974781 | BLASTN | 660 | 1e-46 | 76 |
| 984 | 3835 | 700281434H2 | SATMON019 | g974781 | BLASTN | 560 | 1e-45 | 79 |
| 985 | 3835 | 700084914H1 | SATMON011 | g974781 | BLASTN | 440 | 1e-36 | 79 |
| 986 | 3835 | 700215135H1 | SATMON016 | g974781 | BLASTN | 543 | 1e-36 | 78 |
| 987 | 3835 | 700202218H1 | SATMON003 | g974781 | BLASTN | 389 | 1e-23 | 78 |
| 988 | 3835 | 700281467H2 | SATMON019 | g2738248 | BLASTX | 123 | 1e-12 | 71 |
| 989 | 456 | LIB3059-019-Q1-K1-G6 | LIB3059 | g974781 | BLASTN | 1493 | 1e-115 | 83 |
| 990 | 456 | LIB3068-012-Q1-K1-G7 | LIB3068 | g974781 | BLASTN | 1471 | 1e-113 | 81 |
| 991 | 456 | LIB3061-050-Q1-K1-G10 | LIB3061 | g886470 | BLASTN | 1285 | 1e-98 | 82 |
| 992 | 456 | LIB3067-043-Q1-K1-F9 | LIB3067 | g2738247 | BLASTN | 1287 | 1e-98 | 79 |
| 993 | 456 | 700087169H1 | SATMON011 | g1814402 | BLASTN | 1245 | 1e-94 | 86 |
| 994 | 456 | LIB3069-030-Q1-K1-G9 | LIB3069 | g1814402 | BLASTN | 772 | 1e-93 | 80 |
| 995 | 456 | LIB3069-019-Q1-K1-G11 | LIB3069 | g1814402 | BLASTN | 1202 | 1e-91 | 81 |
| 996 | 456 | 700205514H1 | SATMON003 | g1814402 | BLASTN | 1134 | 1e-89 | 84 |
| 997 | 456 | LIB3062-011-Q1-K1-F2 | LIB3062 | g886470 | BLASTN | 664 | 1e-86 | 84 |
| 998 | 456 | LIB143-015-Q1-E1-A1 | LIB143 | g974781 | BLASTN | 1143 | 1e-86 | 81 |
| 999 | 456 | 700570326H1 | SATMON030 | g974781 | BLASTN | 1089 | 1e-85 | 83 |
| 1000 | 456 | 700103727H1 | SATMON010 | g2738247 | BLASTN | 1132 | 1e-85 | 86 |
| 1001 | 456 | 700574823H1 | SATMON030 | g1814402 | BLASTN | 1135 | 1e-85 | 80 |
| 1002 | 456 | 700091666H1 | SATMON011 | g1814402 | BLASTN | 1136 | 1e-85 | 84 |
| 1003 | 456 | LIB3069-033-Q1-K1-E9 | LIB3069 | g2738247 | BLASTN | 1115 | 1e-84 | 79 |
| 1004 | 456 | 700526634H1 | SATMON030 | g1814402 | BLASTN | 1123 | 1e-84 | 85 |
| 1005 | 456 | 700211829H1 | SATMON016 | g2738247 | BLASTN | 1096 | 1e-82 | 84 |
| 1006 | 456 | 700087109H1 | SATMON011 | g1814402 | BLASTN | 1102 | 1e-82 | 85 |
| 1007 | 456 | LIB3059-003-Q1-K1-B1 | LIB3059 | g1814402 | BLASTN | 961 | 1e-81 | 82 |
| 1008 | 456 | 700047556H1 | SATMON003 | g2738247 | BLASTN | 976 | 1e-81 | 82 |
| 1009 | 456 | 700201925H1 | SATMON003 | g2738247 | BLASTN | 1001 | 1e-81 | 84 |
| 1010 | 456 | 700209343H1 | SATMON016 | g1814402 | BLASTN | 1081 | 1e-81 | 82 |
| 1011 | 456 | 700348416H1 | SATMON023 | g1814402 | BLASTN | 1081 | 1e-81 | 83 |
| 1012 | 456 | 700095559H1 | SATMON008 | g1814402 | BLASTN | 1085 | 1e-81 | 82 |
| 1013 | 456 | 700073472H1 | SATMON007 | g1814402 | BLASTN | 1089 | 1e-81 | 82 |
| 1014 | 456 | LIB3062-057-Q1-K1-C2 | LIB3062 | g886470 | BLASTN | 1073 | 1e-80 | 78 |
| 1015 | 456 | 700093445H1 | SATMON008 | g1814402 | BLASTN | 1076 | 1e-80 | 84 |
| 1016 | 456 | LIB143-026-Q1-E1-H3 | LIB143 | g2738247 | BLASTN | 648 | 1e-79 | 79 |
| 1017 | 456 | 700206240H1 | SATMON003 | g1814402 | BLASTN | 1057 | 1e-79 | 82 |
| 1018 | 456 | 700091907H1 | SATMON011 | g886470 | BLASTN | 1062 | 1e-79 | 80 |
| 1019 | 456 | 700258178H1 | SATMON017 | g1814402 | BLASTN | 1064 | 1e-79 | 84 |
| 1020 | 456 | 700086565H1 | SATMON011 | g1814402 | BLASTN | 1065 | 1e-79 | 82 |
| 1021 | 456 | 700471452H1 | SATMON025 | g2738247 | BLASTN | 1045 | 1e-78 | 85 |
| 1022 | 456 | 700243858H1 | SATMON010 | g1814402 | BLASTN | 1048 | 1e-78 | 85 |
| 1023 | 456 | 700352224H1 | SATMON023 | g2738247 | BLASTN | 1051 | 1e-78 | 84 |
| 1024 | 456 | 700084769H1 | SATMON011 | g1814402 | BLASTN | 1054 | 1e-78 | 83 |
| 1025 | 456 | 700082818H1 | SATMON011 | g886470 | BLASTN | 984 | 1e-77 | 84 |
| 1026 | 456 | 700331974H1 | SATMON019 | g886470 | BLASTN | 1031 | 1e-77 | 82 |
| 1027 | 456 | 700086203H1 | SATMON011 | g1814402 | BLASTN | 1032 | 1e-77 | 81 |
| 1028 | 456 | 700075826H1 | SATMON007 | g2738247 | BLASTN | 1038 | 1e-77 | 82 |
| 1029 | 456 | 700104555H1 | SATMON010 | g886470 | BLASTN | 1039 | 1e-77 | 79 |
| 1030 | 456 | 700074084H1 | SATMON007 | g2738247 | BLASTN | 1039 | 1e-77 | 87 |
| 1031 | 456 | 700076872H1 | SATMON007 | g1814402 | BLASTN | 700 | 1e-76 | 83 |
| 1032 | 456 | 700050704H1 | SATMON003 | g1814402 | BLASTN | 880 | 1e-76 | 82 |
| 1033 | 456 | 700030215H1 | SATMON003 | g974781 | BLASTN | 1019 | 1e-76 | 83 |
| 1034 | 456 | 700077416H1 | SATMON007 | g886470 | BLASTN | 1019 | 1e-76 | 79 |
| 1035 | 456 | 700093982H1 | SATMON008 | g1814402 | BLASTN | 1019 | 1e-76 | 82 |
| 1036 | 456 | 700048847H1 | SATMON003 | g2738247 | BLASTN | 1023 | 1e-76 | 85 |

-continued

5-METHYLTETRAHYDROPTEROYLTRIGLUTAMATE - HOMOCYSTEINE S-METHYLTRANSFERASE (EC 2.1.1.14)

| Seq No. | Cluster ID | CloneID | Library | NCBI gi | Method | Score | P-value | % Ident |
|---|---|---|---|---|---|---|---|---|
| 1037 | 456 | 700090739H1 | SATMON011 | g886470 | BLASTN | 1026 | 1e−76 | 82 |
| 1038 | 456 | 700092904H1 | SATMON008 | g886470 | BLASTN | 1026 | 1e−76 | 82 |
| 1039 | 456 | LIB3068-009-Q1-K1-E5 | LIB3068 | g1814402 | BLASTN | 1027 | 1e−76 | 73 |
| 1040 | 456 | 700336705H1 | SATMON019 | g1814402 | BLASTN | 747 | 1e−75 | 83 |
| 1041 | 456 | 700344872H1 | SATMON021 | g1814402 | BLASTN | 768 | 1e−75 | 85 |
| 1042 | 456 | LIB3066-019-Q1-K1-E1 | LIB3066 | g886470 | BLASTN | 868 | 1e−75 | 81 |
| 1043 | 456 | 700086322H1 | SATMON011 | g2738247 | BLASTN | 1015 | 1e−75 | 81 |
| 1044 | 456 | LIB3067-052-Q1-K1-B12 | LIB3067 | g974781 | BLASTN | 1033 | 1e−75 | 81 |
| 1045 | 456 | 700221395H1 | SATMON011 | g2738247 | BLASTN | 1000 | 1e−74 | 85 |
| 1046 | 456 | 700092483H1 | SATMON008 | g1814402 | BLASTN | 1001 | 1e−74 | 82 |
| 1047 | 456 | 700618708H1 | SATMON034 | g886470 | BLASTN | 1003 | 1e−74 | 82 |
| 1048 | 456 | 700074191H1 | SATMON007 | g2738247 | BLASTN | 1005 | 1e−74 | 86 |
| 1049 | 456 | LIB143-055-Q1-E1-F10 | LIB143 | g1814402 | BLASTN | 986 | 1e−73 | 83 |
| 1050 | 456 | 700025955H1 | SATMON003 | g1814402 | BLASTN | 993 | 1e−73 | 84 |
| 1051 | 456 | 700574824H1 | SATMON030 | g886470 | BLASTN | 564 | 1e−72 | 80 |
| 1052 | 456 | 700201527H1 | SATMON003 | g974781 | BLASTN | 812 | 1e−72 | 81 |
| 1053 | 456 | 700092202H1 | SATMON008 | g886470 | BLASTN | 946 | 1e−72 | 79 |
| 1054 | 456 | 700223674H1 | SATMON011 | g2738247 | BLASTN | 971 | 1e−72 | 83 |
| 1055 | 456 | 700092638H1 | SATMON008 | g1814402 | BLASTN | 972 | 1e−72 | 84 |
| 1056 | 456 | 700090025H1 | SATMON011 | g974781 | BLASTN | 973 | 1e−72 | 81 |
| 1057 | 456 | 700217069H1 | SATMON016 | g2738247 | BLASTN | 976 | 1e−72 | 83 |
| 1058 | 456 | 700349142H1 | SATMON023 | g1814402 | BLASTN | 980 | 1e−72 | 82 |
| 1059 | 456 | 700088387H1 | SATMON011 | g2738247 | BLASTN | 980 | 1e−72 | 85 |
| 1060 | 456 | 700215102H1 | SATMON016 | g886470 | BLASTN | 980 | 1e−72 | 79 |
| 1061 | 456 | 700456708H1 | SATMON029 | g2738247 | BLASTN | 982 | 1e−72 | 82 |
| 1062 | 456 | 700210025H1 | SATMON016 | g1814402 | BLASTN | 982 | 1e−72 | 81 |
| 1063 | 456 | 700335345H1 | SATMON019 | g974781 | BLASTN | 982 | 1e−72 | 84 |
| 1064 | 456 | 700085257H1 | SATMON011 | g1814402 | BLASTN | 554 | 1e−71 | 82 |
| 1065 | 456 | 700026781H1 | SATMON003 | g974781 | BLASTN | 961 | 1e−71 | 82 |
| 1066 | 456 | 700224265H1 | SATMON011 | g2738247 | BLASTN | 962 | 1e−71 | 83 |
| 1067 | 456 | 700083282H1 | SATMON011 | g1814402 | BLASTN | 962 | 1e−71 | 83 |
| 1068 | 456 | 700381324H1 | SATMON023 | g1814402 | BLASTN | 965 | 1e−71 | 82 |
| 1069 | 456 | 700212017H1 | SATMON016 | g1814402 | BLASTN | 640 | 1e−70 | 83 |
| 1070 | 456 | 700088053H1 | SATMON011 | g886470 | BLASTN | 853 | 1e−70 | 84 |
| 1071 | 456 | LIB3062-032-Q1-K1-C2 | LIB3062 | g1814402 | BLASTN | 883 | 1e−70 | 80 |
| 1072 | 456 | 700083030H1 | SATMON011 | g1814402 | BLASTN | 948 | 1e−70 | 81 |
| 1073 | 456 | 700613980H1 | SATMON033 | g1814402 | BLASTN | 950 | 1e−70 | 83 |
| 1074 | 456 | 700347019H1 | SATMON021 | g974781 | BLASTN | 952 | 1e−70 | 81 |
| 1075 | 456 | 700335621H1 | SATMON019 | g1814402 | BLASTN | 952 | 1e−70 | 80 |
| 1076 | 456 | 700094101H1 | SATMON008 | g1814402 | BLASTN | 953 | 1e−70 | 83 |
| 1077 | 456 | 700073128H1 | SATMON007 | g2738247 | BLASTN | 954 | 1e−70 | 78 |
| 1078 | 456 | 700076245H1 | SATMON007 | g1814402 | BLASTN | 955 | 1e−70 | 83 |
| 1079 | 456 | 700071903H1 | SATMON007 | g886470 | BLASTN | 956 | 1e−70 | 81 |
| 1080 | 456 | 700090035H1 | SATMON011 | g886470 | BLASTN | 935 | 1e−69 | 80 |
| 1081 | 456 | 700405323H1 | SATMON029 | g1814402 | BLASTN | 937 | 1e−69 | 83 |
| 1082 | 456 | 700050121H1 | SATMON003 | g886470 | BLASTN | 938 | 1e−69 | 83 |
| 1083 | 456 | 700224714H1 | SATMON011 | g1814402 | BLASTN | 939 | 1e−69 | 82 |
| 1084 | 456 | 700281535H2 | SATMON019 | g1814402 | BLASTN | 940 | 1e−69 | 81 |
| 1085 | 456 | 700222093H1 | SATMON011 | g2738247 | BLASTN | 941 | 1e−69 | 81 |
| 1086 | 456 | 700094659H1 | SATMON008 | g1814402 | BLASTN | 942 | 1e−69 | 84 |
| 1087 | 456 | 700237187H1 | SATMON010 | g1814402 | BLASTN | 942 | 1e−69 | 84 |
| 1088 | 456 | 700023210H1 | SATMON003 | g1814402 | BLASTN | 943 | 1e−69 | 83 |
| 1089 | 456 | 700072813H1 | SATMON007 | g1814402 | BLASTN | 944 | 1e−69 | 82 |
| 1090 | 456 | 700075720H1 | SATMON007 | g1814402 | BLASTN | 946 | 1e−69 | 83 |
| 1091 | 456 | 700072107H1 | SATMON007 | g1814402 | BLASTN | 946 | 1e−69 | 80 |
| 1092 | 456 | 700082225H1 | SATMON011 | g1814402 | BLASTN | 691 | 1e−68 | 82 |
| 1093 | 456 | 700085411H1 | SATMON011 | g1814402 | BLASTN | 723 | 1e−68 | 83 |
| 1094 | 456 | 700454357H1 | SATMON029 | g2738247 | BLASTN | 926 | 1e−68 | 82 |
| 1095 | 456 | 700620976H1 | SATMON034 | g1814402 | BLASTN | 927 | 1e−68 | 81 |
| 1096 | 456 | 700241483H1 | SATMON010 | g1814402 | BLASTN | 931 | 1e−68 | 86 |
| 1097 | 456 | 700355459H1 | SATMON024 | g974781 | BLASTN | 931 | 1e−68 | 82 |
| 1098 | 456 | 700095875H1 | SATMON008 | g1814402 | BLASTN | 931 | 1e−68 | 87 |
| 1099 | 456 | 700076702H1 | SATMON007 | g1814402 | BLASTN | 934 | 1e−68 | 84 |
| 1100 | 456 | 700212538H1 | SATMON016 | g1814402 | BLASTN | 689 | 1e−67 | 85 |
| 1101 | 456 | 700086479H1 | SATMON011 | g1814402 | BLASTN | 715 | 1e−67 | 82 |
| 1102 | 456 | 700453684H1 | SATMON028 | g1814402 | BLASTN | 747 | 1e−67 | 83 |
| 1103 | 456 | 700204454H1 | SATMON003 | g1814402 | BLASTN | 797 | 1e−67 | 82 |
| 1104 | 456 | 700612577H1 | SATMON033 | g974781 | BLASTN | 911 | 1e−67 | 81 |
| 1105 | 456 | 700474018H1 | SATMON025 | g886470 | BLASTN | 917 | 1e−67 | 81 |
| 1106 | 456 | 700213602H1 | SATMON016 | g886470 | BLASTN | 917 | 1e−67 | 76 |
| 1107 | 456 | 700076911H1 | SATMON007 | g974781 | BLASTN | 917 | 1e−67 | 81 |
| 1108 | 456 | 700223313H1 | SATMON011 | g886470 | BLASTN | 919 | 1e−67 | 84 |
| 1109 | 456 | 700220692H1 | SATMON011 | g974781 | BLASTN | 920 | 1e−67 | 81 |

-continued

5-METHYLTETRAHYDROPTEROYLTRIGLUTAMATE - HOMOCYSTEINE S-METHYLTRANSFERASE (EC 2.1.1.14)

| Seq No. | Cluster ID | CloneID | Library | NCBI gi | Method | Score | P-value | % Ident |
|---|---|---|---|---|---|---|---|---|
| 1110 | 456 | 700258038H1 | SATMON017 | g886470 | BLASTN | 920 | 1e−67 | 83 |
| 1111 | 456 | 700095862H1 | SATMON008 | g1814402 | BLASTN | 922 | 1e−67 | 86 |
| 1112 | 456 | 700213396H1 | SATMON016 | g886470 | BLASTN | 922 | 1e−67 | 83 |
| 1113 | 456 | 700354259H1 | SATMON024 | g974781 | BLASTN | 638 | 1e−66 | 81 |
| 1114 | 456 | 700471505H1 | SATMON025 | g886470 | BLASTN | 681 | 1e−66 | 83 |
| 1115 | 456 | 700202439H1 | SATMON003 | g1814402 | BLASTN | 706 | 1e−66 | 82 |
| 1116 | 456 | 700223609H1 | SATMON011 | g974781 | BLASTN | 770 | 1e−66 | 83 |
| 1117 | 456 | 700405260H1 | SATMON028 | g1814402 | BLASTN | 782 | 1e−66 | 86 |
| 1118 | 456 | 700085214H1 | SATMON011 | g886470 | BLASTN | 814 | 1e−66 | 84 |
| 1119 | 456 | 700211194H1 | SATMON016 | g1814402 | BLASTN | 902 | 1e−66 | 84 |
| 1120 | 456 | 700106641H1 | SATMON010 | g1814402 | BLASTN | 903 | 1e−66 | 82 |
| 1121 | 456 | 700405170H1 | SATMON028 | g974781 | BLASTN | 904 | 1e−66 | 79 |
| 1122 | 456 | 700090015H1 | SATMON011 | g886470 | BLASTN | 905 | 1e−66 | 80 |
| 1123 | 456 | 700623154H1 | SATMON034 | g886470 | BLASTN | 906 | 1e−66 | 81 |
| 1124 | 456 | 700458895H1 | SATMON029 | g886470 | BLASTN | 906 | 1e−66 | 83 |
| 1125 | 456 | 700094073H1 | SATMON008 | g886470 | BLASTN | 907 | 1e−66 | 78 |
| 1126 | 456 | 700158508H1 | SATMON012 | g2738247 | BLASTN | 909 | 1e−66 | 82 |
| 1127 | 456 | 700027366H1 | SATMON003 | g1814402 | BLASTN | 910 | 1e−66 | 81 |
| 1128 | 456 | 700073636H1 | SATMON007 | g1814402 | BLASTN | 615 | 1e−65 | 87 |
| 1129 | 456 | 700220207H1 | SATMON011 | g886470 | BLASTN | 785 | 1e−65 | 84 |
| 1130 | 456 | LIB143-007-Q1-E1-A6 | LIB143 | g886470 | BLASTN | 807 | 1e−65 | 80 |
| 1131 | 456 | 700575288H1 | SATMON030 | g1814402 | BLASTN | 887 | 1e−65 | 83 |
| 1132 | 456 | 700219870H1 | SATMON011 | g974781 | BLASTN | 887 | 1e−65 | 82 |
| 1133 | 456 | 701184573H1 | SATMONN06 | g974781 | BLASTN | 888 | 1e−65 | 81 |
| 1134 | 456 | 700079946H1 | SATMON007 | g1814402 | BLASTN | 891 | 1e−65 | 86 |
| 1135 | 456 | 700214808H1 | SATMON016 | g2738247 | BLASTN | 893 | 1e−65 | 81 |
| 1136 | 456 | 700096274H1 | SATMON008 | g1814402 | BLASTN | 894 | 1e−65 | 80 |
| 1137 | 456 | 700160445H1 | SATMON012 | g1814402 | BLASTN | 896 | 1e−65 | 85 |
| 1138 | 456 | 700071727H1 | SATMON007 | g974781 | BLASTN | 898 | 1e−65 | 80 |
| 1139 | 456 | 700571751H1 | SATMON030 | g1814402 | BLASTN | 898 | 1e−65 | 78 |
| 1140 | 456 | 700215107H1 | SATMON016 | g2738247 | BLASTN | 507 | 1e−64 | 77 |
| 1141 | 456 | LIB3067-057-Q1-K1-C6 | LIB3067 | g2738247 | BLASTN | 555 | 1e−64 | 76 |
| 1142 | 456 | 700614743H1 | SATMON033 | g886470 | BLASTN | 748 | 1e−64 | 81 |
| 1143 | 456 | 700444971H1 | SATMON027 | g974781 | BLASTN | 803 | 1e−64 | 83 |
| 1144 | 456 | 700224573H1 | SATMON011 | g1814402 | BLASTN | 805 | 1e−64 | 86 |
| 1145 | 456 | 700019276H1 | SATMON001 | g1814402 | BLASTN | 875 | 1e−64 | 83 |
| 1146 | 456 | 700210440H1 | SATMON016 | g2738247 | BLASTN | 881 | 1e−64 | 80 |
| 1147 | 456 | 700093168H1 | SATMON008 | g1814402 | BLASTN | 885 | 1e−64 | 86 |
| 1148 | 456 | 700224478H1 | SATMON011 | g886470 | BLASTN | 886 | 1e−64 | 81 |
| 1149 | 456 | 700261958H1 | SATMON017 | g1814402 | BLASTN | 781 | 1e−63 | 79 |
| 1150 | 456 | 700074221H1 | SATMON007 | g1814402 | BLASTN | 825 | 1e−63 | 81 |
| 1151 | 456 | 700089966H1 | SATMON011 | g1814402 | BLASTN | 863 | 1e−63 | 84 |
| 1152 | 456 | 700210422H1 | SATMON016 | g1814402 | BLASTN | 863 | 1e−63 | 81 |
| 1153 | 456 | 700160272H1 | SATMON012 | g1814402 | BLASTN | 863 | 1e−63 | 85 |
| 1154 | 456 | 700444282H1 | SATMON027 | g2738247 | BLASTN | 549 | 1e−62 | 84 |
| 1155 | 456 | 700206489H1 | SATMON003 | g2738247 | BLASTN | 597 | 1e−62 | 80 |
| 1156 | 456 | 700446452H1 | SATMON027 | g974781 | BLASTN | 711 | 1e−62 | 80 |
| 1157 | 456 | 700265473H1 | SATMON017 | g1814402 | BLASTN | 715 | 1e−62 | 79 |
| 1158 | 456 | 700473708H1 | SATMON025 | g1814402 | BLASTN | 762 | 1e−62 | 82 |
| 1159 | 456 | LIB3069-025-Q1-K1-A7 | LIB3069 | g886470 | BLASTN | 852 | 1e−62 | 80 |
| 1160 | 456 | 700166631H1 | SATMON013 | g2738247 | BLASTN | 858 | 1e−62 | 85 |
| 1161 | 456 | 700582413H1 | SATMON031 | g1814402 | BLASTN | 861 | 1e−62 | 78 |
| 1162 | 456 | 700071904H1 | SATMON007 | g2738247 | BLASTN | 544 | 1e−61 | 77 |
| 1163 | 456 | 700622655H1 | SATMON034 | g1814402 | BLASTN | 592 | 1e−61 | 82 |
| 1164 | 456 | 700082541H1 | SATMON011 | g1814402 | BLASTN | 793 | 1e−61 | 82 |
| 1165 | 456 | 700335378H1 | SATMON019 | g2738247 | BLASTN | 841 | 1e−61 | 76 |
| 1166 | 456 | 700203585H1 | SATMON003 | g2738247 | BLASTN | 846 | 1e−61 | 86 |
| 1167 | 456 | 700053043H1 | SATMON007 | g2738247 | BLASTN | 847 | 1e−61 | 81 |
| 1168 | 456 | 700163654H1 | SATMON013 | g1814402 | BLASTN | 474 | 1e−60 | 84 |
| 1169 | 456 | 700352269H1 | SATMON023 | g1814402 | BLASTN | 479 | 1e−60 | 84 |
| 1170 | 456 | 700106187H1 | SATMON010 | g1814402 | BLASTN | 631 | 1e−60 | 81 |
| 1171 | 456 | LIB143-007-Q1-E1-A7 | LIB143 | g886470 | BLASTN | 759 | 1e−60 | 76 |
| 1172 | 456 | 700458694H1 | SATMON029 | g1814402 | BLASTN | 827 | 1e−60 | 86 |
| 1173 | 456 | 700213509H1 | SATMON016 | g886470 | BLASTN | 834 | 1e−60 | 81 |
| 1174 | 456 | 700150191H1 | SATMON007 | g2738247 | BLASTN | 834 | 1e−60 | 82 |
| 1175 | 456 | 700157594H1 | SATMON012 | g1814402 | BLASTN | 835 | 1e−60 | 80 |
| 1176 | 456 | 700094046H1 | SATMON008 | g974781 | BLASTN | 836 | 1e−60 | 79 |
| 1177 | 456 | 700220254H1 | SATMON011 | g2738247 | BLASTN | 687 | 1e−59 | 77 |
| 1178 | 456 | 700095485H1 | SATMON008 | g886470 | BLASTN | 819 | 1e−59 | 77 |
| 1179 | 456 | LIB143-006-Q1-E1-B3 | LIB143 | g1814402 | BLASTN | 830 | 1e−59 | 65 |
| 1180 | 456 | 700071763H1 | SATMON007 | g2738247 | BLASTN | 565 | 1e−58 | 75 |
| 1181 | 456 | 700082259H1 | SATMON011 | g1814402 | BLASTN | 707 | 1e−58 | 84 |
| 1182 | 456 | 700020717H1 | SATMON001 | g886470 | BLASTN | 805 | 1e−58 | 81 |

-continued

5-METHYLTETRAHYDROPTEROYLTRIGLUTAMATE - HOMOCYSTEINE S-METHYLTRANSFERASE (EC 2.1.1.14)

| Seq No. | Cluster ID | CloneID | Library | NCBI gi | Method | Score | P-value | % Ident |
|---|---|---|---|---|---|---|---|---|
| 1183 | 456 | 700041892H1 | SATMON004 | g1814402 | BLASTN | 805 | 1e−58 | 86 |
| 1184 | 456 | 700356573H1 | SATMON024 | g1814402 | BLASTN | 811 | 1e−58 | 81 |
| 1185 | 456 | 700171632H1 | SATMON013 | g2738247 | BLASTN | 811 | 1e−58 | 85 |
| 1186 | 456 | 700222516H1 | SATMON011 | g1814402 | BLASTN | 812 | 1e−58 | 87 |
| 1187 | 456 | 700466679H1 | SATMON025 | g1814402 | BLASTN | 812 | 1e−58 | 87 |
| 1188 | 456 | 700208929H1 | SATMON016 | g1814402 | BLASTN | 407 | 1e−57 | 78 |
| 1189 | 456 | 700355014H1 | SATMON024 | g1814402 | BLASTN | 592 | 1e−57 | 85 |
| 1190 | 456 | 701159834H1 | SATMONN04 | g1814402 | BLASTN | 683 | 1e−57 | 77 |
| 1191 | 456 | 700351137H1 | SATMON023 | g974781 | BLASTN | 725 | 1e−57 | 79 |
| 1192 | 456 | 700027308H1 | SATMON003 | g2738247 | BLASTN | 791 | 1e−57 | 80 |
| 1193 | 456 | 700142587H1 | SATMON012 | g974781 | BLASTN | 791 | 1e−57 | 83 |
| 1194 | 456 | 700170157H1 | SATMON013 | g1814402 | BLASTN | 791 | 1e−57 | 81 |
| 1195 | 456 | 700019438H1 | SATMON001 | g974781 | BLASTN | 798 | 1e−57 | 82 |
| 1196 | 456 | 700166430H1 | SATMON013 | g886470 | BLASTN | 799 | 1e−57 | 84 |
| 1197 | 456 | 700047369H1 | SATMON003 | g886470 | BLASTN | 799 | 1e−57 | 80 |
| 1198 | 456 | 700152373H1 | SATMON007 | g2738247 | BLASTN | 799 | 1e−57 | 84 |
| 1199 | 456 | 700050824H1 | SATMON003 | g2738247 | BLASTN | 605 | 1e−56 | 81 |
| 1200 | 456 | 700204588H1 | SATMON003 | g886470 | BLASTN | 720 | 1e−56 | 82 |
| 1201 | 456 | 700071667H1 | SATMON007 | g1814402 | BLASTN | 787 | 1e−56 | 85 |
| 1202 | 456 | 701185269H1 | SATMONN06 | g886470 | BLASTN | 598 | 1e−55 | 76 |
| 1203 | 456 | 700243844H1 | SATMON010 | g2738247 | BLASTN | 769 | 1e−55 | 79 |
| 1204 | 456 | 700221969H1 | SATMON011 | g974781 | BLASTN | 771 | 1e−55 | 79 |
| 1205 | 456 | 700335706H1 | SATMON019 | g1814402 | BLASTN | 773 | 1e−55 | 80 |
| 1206 | 456 | 700622285H1 | SATMON034 | g1814402 | BLASTN | 774 | 1e−55 | 82 |
| 1207 | 456 | 700089665H1 | SATMON011 | g2738247 | BLASTN | 774 | 1e−55 | 78 |
| 1208 | 456 | 700464833H1 | SATMON025 | g2738247 | BLASTN | 455 | 1e−54 | 72 |
| 1209 | 456 | LIB3069-057-Q1-K1-A6 | LIB3069 | g974781 | BLASTN | 564 | 1e−54 | 76 |
| 1210 | 456 | 700156818H1 | SATMON012 | g974781 | BLASTN | 757 | 1e−54 | 81 |
| 1211 | 456 | 700219420H1 | SATMON011 | g974781 | BLASTN | 758 | 1e−54 | 79 |
| 1212 | 456 | 700152570H1 | SATMON007 | g1814402 | BLASTN | 761 | 1e−54 | 86 |
| 1213 | 456 | 700084484H1 | SATMON011 | g1814402 | BLASTN | 764 | 1e−54 | 84 |
| 1214 | 456 | 700152208H1 | SATMON007 | g1814402 | BLASTN | 765 | 1e−54 | 82 |
| 1215 | 456 | 700550889H1 | SATMON022 | g2738247 | BLASTN | 546 | 1e−53 | 76 |
| 1216 | 456 | 700025869H1 | SATMON003 | g2738247 | BLASTN | 675 | 1e−53 | 79 |
| 1217 | 456 | 700383075H1 | SATMON024 | g974781 | BLASTN | 724 | 1e−53 | 81 |
| 1218 | 456 | 700575104H1 | SATMON030 | g1814402 | BLASTN | 745 | 1e−53 | 70 |
| 1219 | 456 | LIB3069-022-Q1-K1-C1 | LIB3069 | g974781 | BLASTN | 768 | 1e−53 | 81 |
| 1220 | 456 | 700215272H1 | SATMON016 | g1814402 | BLASTN | 674 | 1e−52 | 83 |
| 1221 | 456 | 700167881H1 | SATMON013 | g974781 | BLASTN | 737 | 1e−52 | 79 |
| 1222 | 456 | 700019727H1 | SATMON001 | g2738247 | BLASTN | 737 | 1e−52 | 81 |
| 1223 | 456 | 700351776H1 | SATMON023 | g886470 | BLASTN | 741 | 1e−52 | 76 |
| 1224 | 456 | 700210543H1 | SATMON016 | g974781 | BLASTN | 742 | 1e−52 | 85 |
| 1225 | 456 | 700571604H1 | SATMON030 | g1814402 | BLASTN | 360 | 1e−51 | 76 |
| 1226 | 456 | 700169777H1 | SATMON013 | g1814402 | BLASTN | 426 | 1e−51 | 83 |
| 1227 | 456 | 700096744H1 | SATMON008 | g2738247 | BLASTN | 539 | 1e−51 | 79 |
| 1228 | 456 | 700383157H1 | SATMON024 | g974781 | BLASTN | 667 | 1e−51 | 79 |
| 1229 | 456 | 700155764H1 | SATMON007 | g886470 | BLASTN | 721 | 1e−51 | 75 |
| 1230 | 456 | 700150817H1 | SATMON007 | g1814402 | BLASTN | 727 | 1e−51 | 75 |
| 1231 | 456 | 700619660H1 | SATMON034 | g886470 | BLASTN | 727 | 1e−51 | 73 |
| 1232 | 456 | 700471085H1 | SATMON025 | g1814402 | BLASTN | 406 | 1e−50 | 79 |
| 1233 | 456 | 700163226H1 | SATMON013 | g2738247 | BLASTN | 475 | 1e−50 | 78 |
| 1234 | 456 | 700444567H1 | SATMON027 | g1814402 | BLASTN | 498 | 1e−50 | 81 |
| 1235 | 456 | 700457303H1 | SATMON029 | g2738247 | BLASTN | 662 | 1e−50 | 80 |
| 1236 | 456 | 700088065H1 | SATMON011 | g886470 | BLASTN | 707 | 1e−50 | 79 |
| 1237 | 456 | 700152592H1 | SATMON007 | g886470 | BLASTN | 716 | 1e−50 | 80 |
| 1238 | 456 | LIB3068-061-Q1-K1-B2 | LIB3068 | g886470 | BLASTN | 730 | 1e−50 | 78 |
| 1239 | 456 | 700331880H1 | SATMON019 | g1814402 | BLASTN | 697 | 1e−49 | 85 |
| 1240 | 456 | 700218025H1 | SATMON016 | g886470 | BLASTN | 700 | 1e−49 | 79 |
| 1241 | 456 | 700348643H1 | SATMON023 | g1814402 | BLASTN | 701 | 1e−49 | 80 |
| 1242 | 456 | 700236975H1 | SATMON010 | g974781 | BLASTN | 704 | 1e−49 | 81 |
| 1243 | 456 | 700442968H1 | SATMON026 | g886470 | BLASTN | 418 | 1e−48 | 79 |
| 1244 | 456 | 700479529H1 | SATMON034 | g2738247 | BLASTN | 508 | 1e−48 | 75 |
| 1245 | 456 | 700160983H1 | SATMON012 | g1814402 | BLASTN | 690 | 1e−48 | 83 |
| 1246 | 456 | 700050185H1 | SATMON003 | g974781 | BLASTN | 421 | 1e−47 | 75 |
| 1247 | 456 | 700611764H1 | SATMON022 | g1814402 | BLASTN | 503 | 1e−47 | 79 |
| 1248 | 456 | 700622669H1 | SATMON034 | g1814402 | BLASTN | 549 | 1e−47 | 79 |
| 1249 | 456 | 700153237H1 | SATMON007 | g1814402 | BLASTN | 672 | 1e−47 | 80 |
| 1250 | 456 | 700242703H1 | SATMON010 | g886470 | BLASTN | 682 | 1e−47 | 81 |
| 1251 | 456 | 700165177H1 | SATMON013 | g2738247 | BLASTN | 682 | 1e−47 | 78 |
| 1252 | 456 | 700379889H1 | SATMON021 | g886470 | BLASTN | 682 | 1e−47 | 85 |
| 1253 | 456 | 700449243H1 | SATMON028 | g1814402 | BLASTN | 357 | 1e−46 | 83 |
| 1254 | 456 | 700453282H1 | SATMON028 | g886470 | BLASTN | 608 | 1e−46 | 81 |
| 1255 | 456 | 700224308H1 | SATMON011 | g1814402 | BLASTN | 661 | 1e−46 | 83 |

5-METHYLTETRAHYDROPTEROYLTRIGLUTAMATE - HOMOCYSTEINE S-METHYLTRANSFERASE
(EC 2.1.1.14)

| Seq No. | Cluster ID | CloneID | Library | NCBI gi | Method | Score | P-value | % Ident |
|---|---|---|---|---|---|---|---|---|
| 1256 | 456 | 700150484H1 | SATMON007 | g886470 | BLASTN | 663 | 1e-46 | 78 |
| 1257 | 456 | 700240609H1 | SATMON010 | g2738247 | BLASTN | 668 | 1e-46 | 79 |
| 1258 | 456 | 700171610H1 | SATMON013 | g974781 | BLASTN | 669 | 1e-46 | 79 |
| 1259 | 456 | LIB143-027-Q1-E1-H3 | LIB143 | g1814402 | BLASTN | 670 | 1e-46 | 86 |
| 1260 | 456 | 700334084H1 | SATMON019 | g1814402 | BLASTN | 467 | 1e-45 | 81 |
| 1261 | 456 | LIB3069-043-Q1-K1-H6 | LIB3069 | g886470 | BLASTN | 546 | 1e-45 | 83 |
| 1262 | 456 | 700222515H1 | SATMON011 | g1814402 | BLASTN | 648 | 1e-45 | 75 |
| 1263 | 456 | 700223749H1 | SATMON011 | g1814402 | BLASTN | 648 | 1e-45 | 75 |
| 1264 | 456 | 701180187H1 | SATMONN05 | g974781 | BLASTN | 648 | 1e-45 | 78 |
| 1265 | 456 | 700050111H1 | SATMON003 | g2738247 | BLASTN | 653 | 1e-45 | 82 |
| 1266 | 456 | 700051275H1 | SATMON003 | g1814402 | BLASTN | 379 | 1e-44 | 75 |
| 1267 | 456 | 700235202H1 | SATMON010 | g2738247 | BLASTN | 637 | 1e-44 | 80 |
| 1268 | 456 | 700257385H1 | SATMON017 | g1814402 | BLASTN | 638 | 1e-44 | 80 |
| 1269 | 456 | LIB143-028-Q1-E1-H7 | LIB143 | g1814402 | BLASTN | 638 | 1e-44 | 80 |
| 1270 | 456 | 700576066H1 | SATMON030 | g886470 | BLASTN | 516 | 1e-43 | 76 |
| 1271 | 456 | 700455065H1 | SATMON029 | g886470 | BLASTN | 624 | 1e-43 | 79 |
| 1272 | 456 | 700074158H1 | SATMON007 | g1814402 | BLASTN | 630 | 1e-43 | 83 |
| 1273 | 456 | 700171322H1 | SATMON013 | g1814402 | BLASTN | 634 | 1e-43 | 77 |
| 1274 | 456 | 700457369H1 | SATMON029 | g974781 | BLASTN | 392 | 1e-42 | 83 |
| 1275 | 456 | 700378252H1 | SATMON019 | g2738247 | BLASTN | 462 | 1e-42 | 77 |
| 1276 | 456 | 700454626H1 | SATMON029 | g1814402 | BLASTN | 495 | 1e-42 | 85 |
| 1277 | 456 | 700208182H1 | SATMON016 | g2738247 | BLASTN | 564 | 1e-42 | 73 |
| 1278 | 456 | 700618848H1 | SATMON034 | g886470 | BLASTN | 615 | 1e-42 | 80 |
| 1279 | 456 | 700222969H1 | SATMON011 | g1814402 | BLASTN | 622 | 1e-42 | 74 |
| 1280 | 456 | 700444782H1 | SATMON027 | g1814402 | BLASTN | 337 | 1e-41 | 81 |
| 1281 | 456 | 700204404H1 | SATMON003 | g2738247 | BLASTN | 607 | 1e-41 | 80 |
| 1282 | 456 | 700347028H1 | SATMON021 | g1814402 | BLASTN | 598 | 1e-40 | 81 |
| 1283 | 456 | 700172447H1 | SATMON013 | g1814402 | BLASTN | 328 | 1e-39 | 85 |
| 1284 | 456 | 700549696H1 | SATMON022 | g886470 | BLASTN | 360 | 1e-39 | 81 |
| 1285 | 456 | 700257287H1 | SATMON017 | g1814402 | BLASTN | 365 | 1e-38 | 84 |
| 1286 | 456 | 700569630H1 | SATMON030 | g1814402 | BLASTN | 566 | 1e-38 | 78 |
| 1287 | 456 | 700207258H1 | SATMON017 | g1814402 | BLASTN | 568 | 1e-38 | 85 |
| 1288 | 456 | 700052467H1 | SATMON003 | g1814402 | BLASTN | 515 | 1e-37 | 82 |
| 1289 | 456 | 700083656H1 | SATMON011 | g2738247 | BLASTN | 552 | 1e-37 | 83 |
| 1290 | 456 | 700429279H1 | SATMONN01 | g2738247 | BLASTN | 556 | 1e-37 | 79 |
| 1291 | 456 | 700349921H1 | SATMON023 | g2738247 | BLASTN | 471 | 1e-36 | 78 |
| 1292 | 456 | 700449609H1 | SATMON028 | g886470 | BLASTN | 540 | 1e-36 | 81 |
| 1293 | 456 | 700150152H1 | SATMON007 | g1814402 | BLASTN | 543 | 1e-36 | 74 |
| 1294 | 456 | 700075675H1 | SATMON007 | g1814402 | BLASTN | 546 | 1e-36 | 81 |
| 1295 | 456 | 700267015H1 | SATMON017 | g886470 | BLASTN | 550 | 1e-36 | 75 |
| 1296 | 456 | 700465118H1 | SATMON025 | g1814402 | BLASTN | 555 | 1e-36 | 78 |
| 1297 | 456 | 700456662H1 | SATMON029 | g2738247 | BLASTN | 314 | 1e-34 | 76 |
| 1298 | 456 | 700405315H1 | SATMON029 | g886470 | BLASTN | 519 | 1e-34 | 83 |
| 1299 | 456 | 700218639H1 | SATMON011 | g974781 | BLASTN | 524 | 1e-34 | 81 |
| 1300 | 456 | 700216606H1 | SATMON016 | g1814402 | BLASTN | 524 | 1e-34 | 83 |
| 1301 | 456 | 700456965H1 | SATMON029 | g2738247 | BLASTN | 525 | 1e-34 | 78 |
| 1302 | 456 | 700102147H1 | SATMON010 | g974781 | BLASTN | 526 | 1e-34 | 82 |
| 1303 | 456 | 700235734H1 | SATMON010 | g2738247 | BLASTN | 526 | 1e-34 | 83 |
| 1304 | 456 | LIB3068-009-Q1-K1-E10 | LIB3068 | g886470 | BLASTN | 548 | 1e-34 | 70 |
| 1305 | 456 | 700029363H1 | SATMON003 | g974781 | BLASTN | 377 | 1e-33 | 80 |
| 1306 | 456 | LIB3069-030-Q1-K1-D10 | LIB3069 | g886470 | BLASTN | 297 | 1e-30 | 78 |
| 1307 | 456 | 700334895H1 | SATMON019 | g974781 | BLASTN | 468 | 1e-30 | 82 |
| 1308 | 456 | 700150963H1 | SATMON007 | g974781 | BLASTN | 459 | 1e-29 | 88 |
| 1309 | 456 | 700152817H1 | SATMON007 | g974781 | BLASTN | 459 | 1e-29 | 88 |
| 1310 | 456 | 700208732H1 | SATMON016 | g974781 | BLASTN | 485 | 1e-29 | 76 |
| 1311 | 456 | 700051461H1 | SATMON003 | g886470 | BLASTN | 467 | 1e-28 | 73 |
| 1312 | 456 | 700616589H1 | SATMON033 | g2738247 | BLASTN | 273 | 1e-27 | 78 |
| 1313 | 456 | 700236150H1 | SATMON010 | g974781 | BLASTN | 434 | 1e-27 | 84 |
| 1314 | 456 | 700453369H1 | SATMON028 | g1814402 | BLASTN | 436 | 1e-27 | 84 |
| 1315 | 456 | 700621739H1 | SATMON034 | g1814402 | BLASTN | 436 | 1e-27 | 69 |
| 1316 | 456 | 700075162H1 | SATMON007 | g1814402 | BLASTN | 438 | 1e-27 | 85 |
| 1317 | 456 | 700405040H1 | SATMON027 | g974781 | BLASTN | 438 | 1e-27 | 72 |
| 1318 | 456 | 700356893H1 | SATMON024 | g974781 | BLASTN | 458 | 1e-27 | 82 |
| 1319 | 456 | 701185493H1 | SATMONN06 | g886471 | BLASTX | 72 | 1e-26 | 97 |
| 1320 | 456 | 700206095H1 | SATMON003 | g974781 | BLASTN | 421 | 1e-26 | 83 |
| 1321 | 456 | 700083901H1 | SATMON011 | g1814402 | BLASTN | 421 | 1e-26 | 80 |
| 1322 | 456 | LIB3062-026-Q1-K1-D7 | LIB3062 | g1814402 | BLASTN | 423 | 1e-24 | 81 |
| 1323 | 456 | 700377277H1 | SATMON019 | g1814402 | BLASTN | 357 | 1e-20 | 75 |
| 1324 | 456 | 700201214H1 | SATMON003 | g2738248 | BLASTX | 152 | 1e-18 | 77 |
| 1325 | 456 | 700025959H1 | SATMON003 | g886471 | BLASTX | 188 | 1e-18 | 94 |
| 1326 | 456 | 700259484H1 | SATMON017 | g1814402 | BLASTN | 189 | 1e-17 | 82 |
| 1327 | 456 | 700613969H1 | SATMON033 | g886470 | BLASTN | 315 | 1e-17 | 90 |
| 1328 | 456 | 700215602H1 | SATMON016 | g2738248 | BLASTX | 158 | 1e-16 | 74 |

-continued

5-METHYLTETRAHYDROPTEROYLTRIGLUTAMATE - HOMOCYSTEINE S-METHYLTRANSFERASE
(EC 2.1.1.14)

| Seq No. | Cluster ID | CloneID | Library | NCBI gi | Method | Score | P-value | % Ident |
|---|---|---|---|---|---|---|---|---|
| 1329 | 456 | 700438152H1 | SATMON026 | g2738247 | BLASTN | 258 | 1e−16 | 75 |
| 1330 | 456 | 700458654H1 | SATMON026 | g886470 | BLASTN | 330 | 1e−16 | 70 |
| 1331 | 456 | 700449563H1 | SATMON028 | g886471 | BLASTX | 163 | 1e−15 | 89 |
| 1332 | 456 | 700236490H1 | SATMON010 | g1814402 | BLASTX | 276 | 1e−14 | 89 |
| 1333 | 456 | 700456927H1 | SATMON029 | g1814403 | BLASTX | 119 | 1e−13 | 86 |
| 1334 | 456 | 701180088H1 | SATMONN05 | g886471 | BLASTX | 152 | 1e−13 | 60 |
| 1335 | 456 | 700455716H1 | SATMON029 | g2738248 | BLASTX | 111 | 1e−12 | 67 |
| 1336 | 456 | 700573520H1 | SATMON030 | g886471 | BLASTX | 82 | 1e−11 | 84 |
| 1337 | 456 | 700569938H1 | SATMON030 | g2738248 | BLASTX | 132 | 1e−11 | 91 |
| 1338 | 456 | 700551958H1 | SATMON022 | g2738247 | BLASTN | 264 | 1e−11 | 82 |
| 1339 | 456 | 700337475H1 | SATMON020 | g2738247 | BLASTN | 268 | 1e−11 | 83 |
| 1340 | 456 | 700170827H1 | SATMON013 | g886471 | BLASTX | 124 | 1e−10 | 77 |
| 1341 | 456 | 700453382H1 | SATMON028 | g974781 | BLASTN | 152 | 1e−10 | 85 |
| 1342 | 456 | 700089211H1 | SATMON011 | g2738247 | BLASTN | 245 | 1e−9 | 79 |
| 1343 | 456 | 700103155H1 | SATMON010 | g2738248 | BLASTX | 82 | 1e−8 | 85 |
| 1344 | 5523 | LIB3062-017-Q1-K1-F4 | LIB3062 | g2738247 | BLASTN | 932 | 1e−84 | 76 |
| 1345 | 5523 | 700210708H1 | SATMON016 | g2738247 | BLASTN | 952 | 1e−70 | 79 |
| 1346 | 5523 | 700219307H1 | SATMON011 | g1814402 | BLASTN | 892 | 1e−65 | 78 |
| 1347 | 5523 | 700221188H1 | SATMON011 | g2738247 | BLASTN | 867 | 1e−63 | 81 |
| 1348 | 5523 | 700203884H1 | SATMON003 | g2738247 | BLASTN | 874 | 1e−63 | 77 |
| 1349 | 5523 | 700218549H1 | SATMON011 | g2738247 | BLASTN | 811 | 1e−58 | 77 |
| 1350 | 5523 | 700572845H2 | SATMON030 | g2738247 | BLASTN | 785 | 1e−56 | 77 |
| 1351 | 5523 | 700152362H1 | SATMON007 | g886470 | BLASTN | 742 | 1e−52 | 79 |
| 1352 | 5523 | 700152138H1 | SATMON007 | g2738247 | BLASTN | 714 | 1e−50 | 80 |
| 1353 | 5523 | 700218842H1 | SATMON011 | g2738247 | BLASTN | 700 | 1e−49 | 75 |
| 2666 | -700697958 | 700697958H1 | SOYMON015 | g2738247 | BLASTN | 258 | 1e−10 | 83 |
| 2667 | -700731277 | 700731277H1 | SOYMON009 | g886470 | BLASTN | 930 | 1e−68 | 83 |
| 2668 | -700749261 | 700749261H1 | SOYMON013 | g1814402 | BLASTN | 508 | 1e−38 | 78 |
| 2669 | -700787742 | 700787742H2 | SOYMON011 | g1814402 | BLASTN | 648 | 1e−50 | 81 |
| 2670 | -700831146 | 700831146H1 | SOYMON019 | g1814402 | BLASTN | 476 | 1e−34 | 80 |
| 2671 | -700832029 | 700832029H1 | SOYMON019 | g1814402 | BLASTN | 328 | 1e−27 | 78 |
| 2672 | -700854481 | 700854481H1 | SOYMON023 | g1814402 | BLASTN | 193 | 1e−11 | 85 |
| 2673 | -700873716 | 700873716H1 | SOYMON018 | g1749542 | BLASTX | 99 | 1e−15 | 53 |
| 2674 | -700893904 | 700893904H1 | SOYMON024 | g886470 | BLASTN | 413 | 1e−25 | 82 |
| 2675 | -700909658 | 700909658H1 | SOYMON022 | g1814402 | BLASTN | 251 | 1e−10 | 91 |
| 2676 | -700943841 | 700943841H1 | SOYMON024 | g886470 | BLASTN | 549 | 1e−49 | 82 |
| 2677 | -700963223 | 700963223H1 | SOYMON022 | g886470 | BLASTN | 649 | 1e−45 | 72 |
| 2678 | -700974103 | 700974103H1 | SOYMON005 | g886470 | BLASTN | 763 | 1e−54 | 80 |
| 2679 | -700994293 | 700994293H1 | SOYMON011 | g974782 | BLASTX | 97 | 1e−12 | 72 |
| 2680 | -701004816 | 701004816H1 | SOYMON019 | g1814402 | BLASTN | 582 | 1e−39 | 84 |
| 2681 | -701007125 | 701007125H1 | SOYMON019 | g1814403 | BLASTX | 152 | 1e−13 | 87 |
| 2682 | -701008540 | 701008540H1 | SOYMON019 | g886470 | BLASTN | 770 | 1e−55 | 74 |
| 2683 | -701037766 | 701037766H1 | SOYMON029 | g1814403 | BLASTX | 72 | 1e−10 | 69 |
| 2684 | -701062191 | 701062191H1 | SOYMON033 | g974781 | BLASTN | 225 | 1e−9 | 79 |
| 2685 | -701105474 | 701105474H1 | SOYMON036 | g974782 | BLASTX | 164 | 1e−15 | 91 |
| 2686 | -GM14442 | LIB3049-056-Q1-E1-B1 | LIB3049 | g974781 | BLASTN | 231 | 1e−10 | 79 |
| 2687 | -GM19631 | LIB3056-007-Q1-N1-G9 | LIB3056 | g974781 | BLASTN | 388 | 1e−37 | 78 |
| 2688 | -GM37189 | LIB3051-072-Q1-K1-B5 | LIB3051 | g1814402 | BLASTN | 316 | 1e−15 | 78 |
| 2689 | -GM44802 | LIB3053-004-Q1-N1-B2 | LIB3053 | g974782 | BLASTX | 85 | 1e−26 | 90 |
| 2690 | 1382 | 700683236H1 | SOYMON008 | g886470 | BLASTN | 805 | 1e−58 | 78 |
| 2691 | 1382 | 700566434H1 | SOYMON002 | g886471 | BLASTX | 162 | 1e−23 | 76 |
| 2692 | 15690 | 701064361H1 | SOYMON034 | g974781 | BLASTN | 951 | 1e−70 | 84 |
| 2693 | 15690 | 700847301H1 | SOYMON021 | g886470 | BLASTN | 707 | 1e−66 | 85 |
| 2694 | 17335 | LIB3051-088-Q1-K1-D9 | LIB3051 | g886470 | BLASTN | 1285 | 1e−101 | 79 |
| 2695 | 17335 | 701003832H1 | SOYMON019 | g974781 | BLASTN | 811 | 1e−58 | 77 |
| 2696 | 17335 | 700864888H1 | SOYMON016 | g1814402 | BLASTN | 767 | 1e−55 | 79 |
| 2697 | 17335 | 700672491H1 | SOYMON006 | g974781 | BLASTN | 428 | 1e−46 | 75 |
| 2698 | 17335 | 701003457H1 | SOYMON019 | g1814402 | BLASTN | 411 | 1e−29 | 84 |
| 2699 | 17335 | 700833672H1 | SOYMON019 | g974781 | BLASTN | 445 | 1e−28 | 79 |
| 2700 | 17900 | 700850578H1 | SOYMON023 | g2738247 | BLASTN | 905 | 1e−66 | 82 |
| 2701 | 17900 | 701053154H1 | SOYMON032 | g1814402 | BLASTN | 725 | 1e−65 | 83 |
| 2702 | 17900 | 700842351H1 | SOYMON020 | g1814402 | BLASTN | 878 | 1e−64 | 83 |
| 2703 | 17900 | 700837656H1 | SOYMON020 | g1814402 | BLASTN | 841 | 1e−61 | 83 |
| 2704 | 17900 | 700890851H1 | SOYMON024 | g974781 | BLASTN | 747 | 1e−53 | 80 |
| 2705 | 20688 | 700908840H1 | SOYMON022 | g2738247 | BLASTN | 889 | 1e−65 | 82 |
| 2706 | 20688 | 700908848H1 | SOYMON022 | g2738247 | BLASTN | 877 | 1e−64 | 81 |
| 2707 | 33542 | LIB3051-009-Q1-E1-E5 | LIB3051 | g974781 | BLASTN | 1218 | 1e−92 | 79 |
| 2708 | 33542 | 700748773H1 | SOYMON013 | g974781 | BLASTN | 669 | 1e−46 | 78 |
| 2709 | 33542 | 700836363H1 | SOYMON020 | g2738247 | BLASTN | 596 | 1e−40 | 80 |
| 2710 | 4243 | 701123616H1 | SOYMON037 | g1814402 | BLASTN | 995 | 1e−74 | 87 |
| 2711 | 4243 | 700555001H1 | SOYMON001 | g1814402 | BLASTN | 975 | 1e−72 | 90 |
| 2712 | 4243 | 701002967H1 | SOYMON019 | g1814402 | BLASTN | 950 | 1e−70 | 86 |
| 2713 | 4243 | 700653509H1 | SOYMON003 | g1814402 | BLASTN | 539 | 1e−69 | 85 |

-continued

5-METHYLTETRAHYDROPTEROYLTRIGLUTAMATE - HOMOCYSTEINE S-METHYLTRANSFERASE
(EC 2.1.1.14)

| Seq No. | Cluster ID | CloneID | Library | NCBI gi | Method | Score | P-value | % Ident |
|---|---|---|---|---|---|---|---|---|
| 2714 | 4243 | 701206028H1 | SOYMON035 | g1814402 | BLASTN | 938 | 1e−69 | 86 |
| 2715 | 4243 | 700962115H1 | SOYMON022 | g1814402 | BLASTN | 923 | 1e−68 | 86 |
| 2716 | 4243 | 700866243H1 | SOYMON016 | g1814402 | BLASTN | 909 | 1e−66 | 82 |
| 2717 | 4243 | 700752507H1 | SOYMON014 | g1814402 | BLASTN | 887 | 1e−65 | 85 |
| 2718 | 4243 | 701003887H1 | SOYMON019 | g1814402 | BLASTN | 863 | 1e−63 | 86 |
| 2719 | 4243 | 700556913H1 | SOYMON001 | g1814402 | BLASTN | 865 | 1e−63 | 86 |
| 2720 | 4243 | 701013549H1 | SOYMON019 | g1814402 | BLASTN | 867 | 1e−63 | 90 |
| 2721 | 4243 | 701209706H1 | SOYMON035 | g1814402 | BLASTN | 871 | 1e−63 | 90 |
| 2722 | 4243 | 701010487H1 | SOYMON019 | g1814402 | BLASTN | 529 | 1e−62 | 79 |
| 2723 | 4243 | 700548246H1 | SOYMON002 | g1814402 | BLASTN | 553 | 1e−62 | 82 |
| 2724 | 4243 | 701138219H1 | SOYMON038 | g1814402 | BLASTN | 594 | 1e−62 | 86 |
| 2725 | 4243 | 700965160H1 | SOYMON022 | g1814402 | BLASTN | 852 | 1e−62 | 91 |
| 2726 | 4243 | 701015168H1 | SOYMON019 | g1814402 | BLASTN | 855 | 1e−62 | 89 |
| 2727 | 4243 | 701136095H1 | SOYMON038 | g1814402 | BLASTN | 839 | 1e−61 | 88 |
| 2728 | 4243 | 700761789H1 | SOYMON015 | g1814402 | BLASTN | 845 | 1e−61 | 86 |
| 2729 | 4243 | 701105695H1 | SOYMON036 | g1814402 | BLASTN | 835 | 1e−60 | 87 |
| 2730 | 4243 | 700991714H1 | SOYMON011 | g1814402 | BLASTN | 502 | 1e−59 | 83 |
| 2731 | 4243 | 700564223H1 | SOYMON002 | g1814402 | BLASTN | 557 | 1e−59 | 90 |
| 2732 | 4243 | 700987384H1 | SOYMON009 | g1814402 | BLASTN | 803 | 1e−58 | 86 |
| 2733 | 4243 | 700833934H1 | SOYMON019 | g1814402 | BLASTN | 806 | 1e−58 | 89 |
| 2734 | 4243 | 700835181H1 | SOYMON019 | g1814402 | BLASTN | 806 | 1e−58 | 82 |
| 2735 | 4243 | 700737529H1 | SOYMON010 | g1814402 | BLASTN | 810 | 1e−58 | 92 |
| 2736 | 4243 | 701012851H1 | SOYMON019 | g1814402 | BLASTN | 811 | 1e−58 | 91 |
| 2737 | 4243 | 700556592H1 | SOYMON001 | g1814402 | BLASTN | 814 | 1e−58 | 88 |
| 2738 | 4243 | 700907579H1 | SOYMON022 | g1814402 | BLASTN | 781 | 1e−56 | 89 |
| 2739 | 4243 | 700961749H1 | SOYMON022 | g1814402 | BLASTN | 785 | 1e−56 | 91 |
| 2740 | 4243 | 700835239H1 | SOYMON019 | g1814402 | BLASTN | 787 | 1e−56 | 86 |
| 2741 | 4243 | 700646425H1 | SOYMON013 | g1814402 | BLASTN | 772 | 1e−55 | 89 |
| 2742 | 4243 | 701123924H1 | SOYMON037 | g1814402 | BLASTN | 775 | 1e−55 | 91 |
| 2743 | 4243 | 700957759H1 | SOYMON022 | g1814402 | BLASTN | 776 | 1e−55 | 90 |
| 2744 | 4243 | 700964425H1 | SOYMON022 | g1814402 | BLASTN | 777 | 1e−55 | 86 |
| 2745 | 4243 | 700962173H1 | SOYMON022 | g1814402 | BLASTN | 778 | 1e−55 | 91 |
| 2746 | 4243 | 701066293H1 | SOYMON034 | g1814402 | BLASTN | 759 | 1e−54 | 81 |
| 2747 | 4243 | 700986741H1 | SOYMON009 | g1814402 | BLASTN | 589 | 1e−53 | 84 |
| 2748 | 4243 | 701212514H1 | SOYMON035 | g1814402 | BLASTN | 591 | 1e−53 | 87 |
| 2749 | 4243 | 701009195H1 | SOYMON019 | g1814402 | BLASTN | 747 | 1e−53 | 91 |
| 2750 | 4243 | 701060510H1 | SOYMON033 | g1814402 | BLASTN | 748 | 1e−53 | 84 |
| 2751 | 4243 | 700848730H1 | SOYMON021 | g1814402 | BLASTN | 749 | 1e−53 | 90 |
| 2752 | 4243 | 700754870H1 | SOYMON014 | g1814402 | BLASTN | 751 | 1e−53 | 84 |
| 2753 | 4243 | 701212482H1 | SOYMON035 | g1814402 | BLASTN | 751 | 1e−53 | 84 |
| 2754 | 4243 | 700753283H1 | SOYMON014 | g1814402 | BLASTN | 752 | 1e−53 | 86 |
| 2755 | 4243 | 700738517H1 | SOYMON012 | g1814402 | BLASTN | 636 | 1e−52 | 89 |
| 2756 | 4243 | 700833978H1 | SOYMON019 | g1814402 | BLASTN | 740 | 1e−52 | 91 |
| 2757 | 4243 | 700756424H1 | SOYMON014 | g1814402 | BLASTN | 729 | 1e−51 | 82 |
| 2758 | 4243 | 701011759H1 | SOYMON019 | g1814402 | BLASTN | 729 | 1e−51 | 91 |
| 2759 | 4243 | 701010103H2 | SOYMON019 | g1814402 | BLASTN | 707 | 1e−50 | 82 |
| 2760 | 4243 | 700741392H1 | SOYMON012 | g1814402 | BLASTN | 707 | 1e−50 | 84 |
| 2761 | 4243 | 701123062H1 | SOYMON037 | g1814402 | BLASTN | 308 | 1e−49 | 88 |
| 2762 | 4243 | 701048949H1 | SOYMON032 | g1814402 | BLASTN | 502 | 1e−49 | 85 |
| 2763 | 4243 | 700834566H1 | SOYMON019 | g1814402 | BLASTN | 618 | 1e−49 | 88 |
| 2764 | 4243 | 700963965H1 | SOYMON022 | g1814402 | BLASTN | 685 | 1e−48 | 78 |
| 2765 | 4243 | 700986376H1 | SOYMON009 | g1814402 | BLASTN | 694 | 1e−48 | 84 |
| 2766 | 4243 | 701012708H1 | SOYMON019 | g1814402 | BLASTN | 521 | 1e−47 | 91 |
| 2767 | 4243 | 700746927H1 | SOYMON013 | g1814402 | BLASTN | 547 | 1e−46 | 78 |
| 2768 | 4243 | 700997448H1 | SOYMON018 | g1814402 | BLASTN | 470 | 1e−45 | 89 |
| 2769 | 4243 | 700830667H1 | SOYMON019 | g1814402 | BLASTN | 647 | 1e−45 | 86 |
| 2770 | 4243 | 700891479H1 | SOYMON024 | g1814402 | BLASTN | 654 | 1e−45 | 88 |
| 2771 | 4243 | 700562246H1 | SOYMON002 | g1814402 | BLASTN | 656 | 1e−45 | 86 |
| 2772 | 4243 | 701097325H1 | SOYMON028 | g1814402 | BLASTN | 420 | 1e−44 | 92 |
| 2773 | 4243 | 700835830H1 | SOYMON019 | g1814402 | BLASTN | 503 | 1e−44 | 86 |
| 2774 | 4243 | 700962969H1 | SOYMON022 | g1814402 | BLASTN | 515 | 1e−44 | 89 |
| 2775 | 4243 | 701102860H1 | SOYMON028 | g1814402 | BLASTN | 309 | 1e−42 | 92 |
| 2776 | 4243 | 700763506H1 | SOYMON015 | g1814402 | BLASTN | 456 | 1e−42 | 84 |
| 2777 | 4243 | 700994059H1 | SOYMON011 | g1814402 | BLASTN | 487 | 1e−42 | 87 |
| 2778 | 4243 | 700751551H1 | SOYMON014 | g1814402 | BLASTN | 568 | 1e−41 | 85 |
| 2779 | 4243 | 701108872H1 | SOYMON036 | g1814402 | BLASTN | 603 | 1e−41 | 85 |
| 2780 | 4243 | 700994053H1 | SOYMON011 | g1814402 | BLASTN | 587 | 1e−40 | 85 |
| 2781 | 4243 | 700729064H1 | SOYMON009 | g1814402 | BLASTN | 413 | 1e−38 | 90 |
| 2782 | 4243 | 700874176H1 | SOYMON018 | g1814402 | BLASTN | 468 | 1e−38 | 92 |
| 2783 | 4243 | 700742963H1 | SOYMON012 | g1814402 | BLASTN | 565 | 1e−38 | 86 |
| 2784 | 4243 | 701212923H1 | SOYMON035 | g1814402 | BLASTN | 572 | 1e−38 | 84 |
| 2785 | 4243 | 700994851H1 | SOYMON011 | g1814402 | BLASTN | 548 | 1e−36 | 76 |
| 2786 | 4243 | 701000193H1 | SOYMON018 | g1814402 | BLASTN | 296 | 1e−33 | 87 |

-continued

5-METHYLTETRAHYDROPTEROYLTRIGLUTAMATE - HOMOCYSTEINE S-METHYLTRANSFERASE (EC 2.1.1.14)

| Seq No. | Cluster ID | CloneID | Library | NCBI gi | Method | Score | P-value | % Ident |
|---|---|---|---|---|---|---|---|---|
| 2787 | 4243 | 700756219H1 | SOYMON014 | g1814402 | BLASTN | 394 | 1e−32 | 80 |
| 2788 | 4243 | 701014751H1 | SOYMON019 | g1814402 | BLASTN | 461 | 1e−29 | 90 |
| 2789 | 4243 | 700561163H1 | SOYMON002 | g1814402 | BLASTN | 231 | 1e−25 | 89 |
| 2790 | 4243 | 700650284H1 | SOYMON003 | g974782 | BLASTX | 157 | 1e−14 | 96 |
| 2791 | 4243 | 700869218H1 | SOYMON016 | g1814402 | BLASTN | 248 | 1e−11 | 93 |
| 2792 | 550 | LIB3028-007-Q1-B1-B6 | LIB3028 | g886470 | BLASTN | 1440 | 1e−111 | 81 |
| 2793 | 550 | LIB3040-017-Q1-E1-E8 | LIB3040 | g886470 | BLASTN | 1260 | 1e−96 | 80 |
| 2794 | 550 | 700650656H1 | SOYMON003 | g1814402 | BLASTN | 1072 | 1e−93 | 83 |
| 2795 | 550 | LIB3051-091-Q1-K1-C2 | LIB3051 | g886470 | BLASTN | 1124 | 1e−89 | 80 |
| 2796 | 550 | LIB3051-072-Q1-K1-B3 | LIB3051 | g974781 | BLASTN | 1114 | 1e−83 | 82 |
| 2797 | 550 | LIB3051-006-Q1-E1-G9 | LIB3051 | g974781 | BLASTN | 703 | 1e−82 | 81 |
| 2798 | 550 | 700563811H1 | SOYMON002 | g1814402 | BLASTN | 1071 | 1e−80 | 84 |
| 2799 | 550 | 700754104H1 | SOYMON014 | g974781 | BLASTN | 1052 | 1e−78 | 86 |
| 2800 | 550 | 701002973H1 | SOYMON019 | g1814402 | BLASTN | 1039 | 1e−77 | 85 |
| 2801 | 550 | 700986733H1 | SOYMON009 | g974781 | BLASTN | 1039 | 1e−77 | 83 |
| 2802 | 550 | 700557995H1 | SOYMON001 | g886470 | BLASTN | 1019 | 1e−76 | 83 |
| 2803 | 550 | 700563477H1 | SOYMON002 | g2738247 | BLASTN | 1024 | 1e−76 | 85 |
| 2804 | 550 | 700976112H1 | SOYMON009 | g886470 | BLASTN | 1024 | 1e−76 | 84 |
| 2805 | 550 | 701004884H1 | SOYMON019 | g1814402 | BLASTN | 1007 | 1e−75 | 84 |
| 2806 | 550 | 700889161H1 | SOYMON024 | g974781 | BLASTN | 996 | 1e−74 | 85 |
| 2807 | 550 | 700833110H1 | SOYMON019 | g974781 | BLASTN | 998 | 1e−74 | 87 |
| 2808 | 550 | 701124559H1 | SOYMON037 | g974781 | BLASTN | 1002 | 1e−74 | 86 |
| 2809 | 550 | 700729207H1 | SOYMON009 | g974781 | BLASTN | 1004 | 1e−74 | 85 |
| 2810 | 550 | 700730012H1 | SOYMON009 | g886470 | BLASTN | 987 | 1e−73 | 85 |
| 2811 | 550 | 700987128H1 | SOYMON009 | g2738247 | BLASTN | 989 | 1e−73 | 85 |
| 2812 | 550 | 700564788H1 | SOYMON002 | g974781 | BLASTN | 990 | 1e−73 | 84 |
| 2813 | 550 | 701099104H1 | SOYMON028 | g1814402 | BLASTN | 994 | 1e−73 | 86 |
| 2814 | 550 | LIB3065-008-Q1-N1-B4 | LIB3065 | g2738247 | BLASTN | 839 | 1e−72 | 83 |
| 2815 | 550 | 701104283H1 | SOYMON036 | g974781 | BLASTN | 976 | 1e−72 | 83 |
| 2816 | 550 | 700726387H1 | SOYMON009 | g974781 | BLASTN | 980 | 1e−72 | 84 |
| 2817 | 550 | 700900884H1 | SOYMON027 | g1814402 | BLASTN | 982 | 1e−72 | 85 |
| 2818 | 550 | LIB3051-029-Q1-K1-D6 | LIB3051 | g886470 | BLASTN | 824 | 1e−71 | 81 |
| 2819 | 550 | 701213995H1 | SOYMON035 | g1814402 | BLASTN | 962 | 1e−71 | 84 |
| 2820 | 550 | 700683596H1 | SOYMON008 | g1814402 | BLASTN | 968 | 1e−71 | 85 |
| 2821 | 550 | 700646529H1 | SOYMON014 | g1814402 | BLASTN | 867 | 1e−70 | 84 |
| 2822 | 550 | 700756704H1 | SOYMON014 | g1814402 | BLASTN | 893 | 1e−70 | 87 |
| 2823 | 550 | 700991647H1 | SOYMON011 | g1814402 | BLASTN | 947 | 1e−70 | 84 |
| 2824 | 550 | 700962195H1 | SOYMON022 | g974781 | BLASTN | 947 | 1e−70 | 87 |
| 2825 | 550 | 700994369H1 | SOYMON011 | g1814402 | BLASTN | 949 | 1e−70 | 84 |
| 2826 | 550 | 700672477H1 | SOYMON006 | g1814402 | BLASTN | 951 | 1e−70 | 85 |
| 2827 | 550 | 700946215H1 | SOYMON024 | g2738247 | BLASTN | 957 | 1e−70 | 83 |
| 2828 | 550 | 701152765H1 | SOYMON031 | g974781 | BLASTN | 958 | 1e−70 | 88 |
| 2829 | 550 | 701010552H1 | SOYMON019 | g974781 | BLASTN | 501 | 1e−69 | 83 |
| 2830 | 550 | LIB3056-004-Q1-N1-B12 | LIB3056 | g2738247 | BLASTN | 698 | 1e−69 | 77 |
| 2831 | 550 | 701100656H1 | SOYMON028 | g974781 | BLASTN | 890 | 1e−69 | 85 |
| 2832 | 550 | 700985362H1 | SOYMON009 | g1814402 | BLASTN | 937 | 1e−69 | 82 |
| 2833 | 550 | 700746178H1 | SOYMON013 | g974781 | BLASTN | 938 | 1e−69 | 85 |
| 2834 | 550 | 700674440H1 | SOYMON007 | g974781 | BLASTN | 938 | 1e−69 | 83 |
| 2835 | 550 | 700556934H1 | SOYMON001 | g1814402 | BLASTN | 938 | 1e−69 | 82 |
| 2836 | 550 | 700652624H1 | SOYMON003 | g1814402 | BLASTN | 939 | 1e−69 | 82 |
| 2837 | 550 | 700952331H1 | SOYMON022 | g886470 | BLASTN | 946 | 1e−69 | 83 |
| 2838 | 550 | 700725576H1 | SOYMON009 | g886470 | BLASTN | 946 | 1e−69 | 85 |
| 2839 | 550 | 701003602H1 | SOYMON019 | g2738247 | BLASTN | 924 | 1e−68 | 83 |
| 2840 | 550 | 700745053H1 | SOYMON013 | g974781 | BLASTN | 924 | 1e−68 | 85 |
| 2841 | 550 | 700895781H1 | SOYMON027 | g1814402 | BLASTN | 926 | 1e−68 | 84 |
| 2842 | 550 | 700664593H1 | SOYMON005 | g974781 | BLASTN | 926 | 1e−68 | 87 |
| 2843 | 550 | 700864264H1 | SOYMON016 | g1814402 | BLASTN | 930 | 1e−68 | 84 |
| 2844 | 550 | 700674466H1 | SOYMON007 | g974781 | BLASTN | 933 | 1e−68 | 83 |
| 2845 | 550 | 700564170H1 | SOYMON002 | g974781 | BLASTN | 861 | 1e−67 | 83 |
| 2846 | 550 | 700654531H1 | SOYMON004 | g974781 | BLASTN | 911 | 1e−67 | 81 |
| 2847 | 550 | 700996341H1 | SOYMON018 | g886470 | BLASTN | 911 | 1e−67 | 83 |
| 2848 | 550 | 701136257H1 | SOYMON038 | g886470 | BLASTN | 912 | 1e−67 | 82 |
| 2849 | 550 | 700751114H1 | SOYMON014 | g1814402 | BLASTN | 914 | 1e−67 | 84 |
| 2850 | 550 | 700657606H1 | SOYMON004 | g1814402 | BLASTN | 916 | 1e−67 | 87 |
| 2851 | 550 | 700983827H1 | SOYMON009 | g974781 | BLASTN | 918 | 1e−67 | 85 |
| 2852 | 550 | 700981249H1 | SOYMON009 | g1814402 | BLASTN | 921 | 1e−67 | 80 |
| 2853 | 550 | 700836103H1 | SOYMON019 | g886470 | BLASTN | 922 | 1e−67 | 82 |
| 2854 | 550 | 701011869H1 | SOYMON019 | g974781 | BLASTN | 486 | 1e−66 | 86 |
| 2855 | 550 | 701097045H1 | SOYMON028 | g886470 | BLASTN | 601 | 1e−66 | 85 |
| 2856 | 550 | 701012695H1 | SOYMON019 | g974781 | BLASTN | 777 | 1e−66 | 85 |
| 2857 | 550 | 700945396H1 | SOYMON024 | g974781 | BLASTN | 902 | 1e−66 | 85 |
| 2858 | 550 | 700755390H1 | SOYMON014 | g974781 | BLASTN | 903 | 1e−66 | 86 |
| 2859 | 550 | 700967721H1 | SOYMON033 | g886470 | BLASTN | 910 | 1e−66 | 82 |

-continued

5-METHYLTETRAHYDROPTEROYLTRIGLUTAMATE - HOMOCYSTEINE S-METHYLTRANSFERASE
(EC 2.1.1.14)

| Seq No. | Cluster ID | CloneID | Library | NCBI gi | Method | Score | P-value | % Ident |
|---|---|---|---|---|---|---|---|---|
| 2860 | 550 | 700750610H1 | SOYMON014 | g974781 | BLASTN | 910 | 1e−66 | 84 |
| 2861 | 550 | 700908231H1 | SOYMON022 | g974781 | BLASTN | 527 | 1e−65 | 83 |
| 2862 | 550 | 701003835H1 | SOYMON019 | g886470 | BLASTN | 723 | 1e−65 | 82 |
| 2863 | 550 | 700790802H1 | SOYMON011 | g2738247 | BLASTN | 891 | 1e−65 | 82 |
| 2864 | 550 | 701053438H1 | SOYMON032 | g974781 | BLASTN | 893 | 1e−65 | 82 |
| 2865 | 550 | 701009430H1 | SOYMON019 | g974781 | BLASTN | 894 | 1e−65 | 85 |
| 2866 | 550 | 700891415H1 | SOYMON024 | g1814402 | BLASTN | 895 | 1e−65 | 84 |
| 2867 | 550 | 701100681H1 | SOYMON028 | g2738247 | BLASTN | 482 | 1e−64 | 84 |
| 2868 | 550 | 700893420H1 | SOYMON024 | g974781 | BLASTN | 570 | 1e−64 | 89 |
| 2869 | 550 | 700752741H1 | SOYMON014 | g886470 | BLASTN | 880 | 1e−64 | 82 |
| 2870 | 550 | 700955938H1 | SOYMON022 | g1814402 | BLASTN | 882 | 1e−64 | 81 |
| 2871 | 550 | 701015042H1 | SOYMON019 | g2738247 | BLASTN | 886 | 1e−64 | 82 |
| 2872 | 550 | LIB3051-072-Q1-K1-B1 | LIB3051 | g974781 | BLASTN | 645 | 1e−63 | 76 |
| 2873 | 550 | 700741918H1 | SOYMON012 | g886470 | BLASTN | 722 | 1e−63 | 84 |
| 2874 | 550 | 701103319H1 | SOYMON028 | g974781 | BLASTN | 792 | 1e−63 | 82 |
| 2875 | 550 | 700833218H1 | SOYMON019 | g2738247 | BLASTN | 863 | 1e−63 | 81 |
| 2876 | 550 | 701008071H1 | SOYMON019 | g886470 | BLASTN | 867 | 1e−63 | 83 |
| 2877 | 550 | 700832073H1 | SOYMON019 | g974781 | BLASTN | 871 | 1e−63 | 83 |
| 2878 | 550 | 700889695H1 | SOYMON024 | g974781 | BLASTN | 872 | 1e−63 | 83 |
| 2879 | 550 | 701007489H2 | SOYMON019 | g974781 | BLASTN | 873 | 1e−63 | 84 |
| 2880 | 550 | 700895858H1 | SOYMON027 | g974781 | BLASTN | 874 | 1e−63 | 84 |
| 2881 | 550 | 700753955H1 | SOYMON014 | g974781 | BLASTN | 470 | 1e−62 | 87 |
| 2882 | 550 | 700564433H1 | SOYMON002 | g886470 | BLASTN | 757 | 1e−62 | 84 |
| 2883 | 550 | 700963115H1 | SOYMON022 | g974781 | BLASTN | 851 | 1e−62 | 83 |
| 2884 | 550 | 700894728H1 | SOYMON024 | g886470 | BLASTN | 860 | 1e−62 | 84 |
| 2885 | 550 | 701056915H1 | SOYMON033 | g886470 | BLASTN | 862 | 1e−62 | 84 |
| 2886 | 550 | 700741134H1 | SOYMON012 | g886470 | BLASTN | 862 | 1e−62 | 83 |
| 2887 | 550 | 700847591H1 | SOYMON021 | g974781 | BLASTN | 842 | 1e−61 | 84 |
| 2888 | 550 | 700941253H1 | SOYMON024 | g2738247 | BLASTN | 844 | 1e−61 | 80 |
| 2889 | 550 | 701004315H1 | SOYMON019 | g2738247 | BLASTN | 846 | 1e−61 | 83 |
| 2890 | 550 | 700895720H1 | SOYMON027 | g974781 | BLASTN | 848 | 1e−61 | 83 |
| 2891 | 550 | 701013541H1 | SOYMON019 | g974781 | BLASTN | 849 | 1e−61 | 84 |
| 2892 | 550 | 700892552H1 | SOYMON024 | g886470 | BLASTN | 719 | 1e−60 | 83 |
| 2893 | 550 | 701141313H1 | SOYMON038 | g974781 | BLASTN | 827 | 1e−60 | 83 |
| 2894 | 550 | 701012547H1 | SOYMON019 | g1814402 | BLASTN | 831 | 1e−60 | 83 |
| 2895 | 550 | 701008558H1 | SOYMON019 | g1814402 | BLASTN | 831 | 1e−60 | 83 |
| 2896 | 550 | 700902022H1 | SOYMON027 | g2738247 | BLASTN | 831 | 1e−60 | 82 |
| 2897 | 550 | 700959515H1 | SOYMON022 | g886470 | BLASTN | 832 | 1e−60 | 81 |
| 2898 | 550 | 701042630H1 | SOYMON029 | g1814402 | BLASTN | 819 | 1e−59 | 81 |
| 2899 | 550 | 700941292H1 | SOYMON024 | g2738247 | BLASTN | 820 | 1e−59 | 81 |
| 2900 | 550 | 700788526H1 | SOYMON011 | g974781 | BLASTN | 491 | 1e−58 | 82 |
| 2901 | 550 | 700894839H1 | SOYMON024 | g1814402 | BLASTN | 498 | 1e−58 | 82 |
| 2902 | 550 | 700865873H1 | SOYMON016 | g974781 | BLASTN | 808 | 1e−58 | 85 |
| 2903 | 550 | 701015435H1 | SOYMON019 | g886470 | BLASTN | 809 | 1e−58 | 80 |
| 2904 | 550 | 700755960H1 | SOYMON014 | g2738247 | BLASTN | 809 | 1e−58 | 78 |
| 2905 | 550 | 700876051H1 | SOYMON018 | g886470 | BLASTN | 434 | 1e−57 | 81 |
| 2906 | 550 | 701041327H1 | SOYMON029 | g886470 | BLASTN | 499 | 1e−57 | 83 |
| 2907 | 550 | 701098902H1 | SOYMON028 | g2738247 | BLASTN | 767 | 1e−57 | 77 |
| 2908 | 550 | 700853392H1 | SOYMON023 | g886470 | BLASTN | 793 | 1e−57 | 82 |
| 2909 | 550 | 700872645H1 | SOYMON018 | g974781 | BLASTN | 798 | 1e−57 | 83 |
| 2910 | 550 | 700989675H1 | SOYMON011 | g2738247 | BLASTN | 800 | 1e−57 | 79 |
| 2911 | 550 | 700753487H1 | SOYMON014 | g1814402 | BLASTN | 589 | 1e−56 | 83 |
| 2912 | 550 | 700736276H1 | SOYMON010 | g1814402 | BLASTN | 782 | 1e−56 | 79 |
| 2913 | 550 | 700891361H1 | SOYMON024 | g1814402 | BLASTN | 783 | 1e−56 | 81 |
| 2914 | 550 | 700829712H1 | SOYMON019 | g974781 | BLASTN | 790 | 1e−56 | 80 |
| 2915 | 550 | LIB3050-019-Q1-K1-A1 | LIB3050 | g974781 | BLASTN | 663 | 1e−55 | 81 |
| 2916 | 550 | 701001013H1 | SOYMON018 | g1814402 | BLASTN | 768 | 1e−55 | 84 |
| 2917 | 550 | LIB3028-031-Q1-B1-G12 | LIB3028 | g886470 | BLASTN | 775 | 1e−55 | 82 |
| 2918 | 550 | 701212782H1 | SOYMON035 | g886470 | BLASTN | 621 | 1e−54 | 82 |
| 2919 | 550 | 701008695H1 | SOYMON019 | g974781 | BLASTN | 718 | 1e−54 | 80 |
| 2920 | 550 | 700990972H1 | SOYMON011 | g1814402 | BLASTN | 766 | 1e−54 | 81 |
| 2921 | 550 | 700789576H2 | SOYMON011 | g886470 | BLASTN | 766 | 1e−54 | 80 |
| 2922 | 550 | 700994266H1 | SOYMON011 | g1814402 | BLASTN | 408 | 1e−53 | 85 |
| 2923 | 550 | 700731985H1 | SOYMON010 | g974781 | BLASTN | 590 | 1e−53 | 81 |
| 2924 | 550 | 700907927H1 | SOYMON022 | g886470 | BLASTN | 612 | 1e−53 | 80 |
| 2925 | 550 | 701012079H1 | SOYMON019 | g974781 | BLASTN | 669 | 1e−53 | 86 |
| 2926 | 550 | 700753939H1 | SOYMON014 | g886470 | BLASTN | 690 | 1e−53 | 78 |
| 2927 | 550 | 701000754H1 | SOYMON018 | g974781 | BLASTN | 745 | 1e−53 | 76 |
| 2928 | 550 | 701040287H1 | SOYMON029 | g886470 | BLASTN | 747 | 1e−53 | 82 |
| 2929 | 550 | 700891329H1 | SOYMON024 | g974781 | BLASTN | 749 | 1e−53 | 79 |
| 2930 | 550 | 700897258H1 | SOYMON027 | g886470 | BLASTN | 752 | 1e−53 | 86 |
| 2931 | 550 | 700944949H1 | SOYMON024 | g974781 | BLASTN | 426 | 1e−52 | 82 |
| 2932 | 550 | 701108671H1 | SOYMON036 | g1814402 | BLASTN | 731 | 1e−52 | 77 |

5-METHYLTETRAHYDROPTEROYLTRIGLUTAMATE - HOMOCYSTEINE S-METHYLTRANSFERASE (EC 2.1.1.14)

| Seq No. | Cluster ID | CloneID | Library | NCBI gi | Method | Score | P-value | % Ident |
|---|---|---|---|---|---|---|---|---|
| 2933 | 550 | 700905233H1 | SOYMON022 | g886470 | BLASTN | 732 | 1e−52 | 77 |
| 2934 | 550 | 700958589H1 | SOYMON022 | g886470 | BLASTN | 738 | 1e−52 | 80 |
| 2935 | 550 | 700666436H1 | SOYMON005 | g2738247 | BLASTN | 739 | 1e−52 | 82 |
| 2936 | 550 | 700829902H1 | SOYMON019 | g886470 | BLASTN | 740 | 1e−52 | 82 |
| 2937 | 550 | 700740110H1 | SOYMON012 | g974781 | BLASTN | 742 | 1e−52 | 83 |
| 2938 | 550 | 700989055H1 | SOYMON011 | g886470 | BLASTN | 538 | 1e−50 | 79 |
| 2939 | 550 | 701213370H1 | SOYMON035 | g974781 | BLASTN | 599 | 1e−50 | 83 |
| 2940 | 550 | 701098072H1 | SOYMON028 | g974781 | BLASTN | 709 | 1e−50 | 74 |
| 2941 | 550 | 700896128H1 | SOYMON027 | g886470 | BLASTN | 714 | 1e−50 | 83 |
| 2942 | 550 | 701060755H1 | SOYMON033 | g974781 | BLASTN | 716 | 1e−50 | 74 |
| 2943 | 550 | 700953594H1 | SOYMON022 | g1814402 | BLASTN | 695 | 1e−49 | 78 |
| 2944 | 550 | 701046911H1 | SOYMON032 | g2738247 | BLASTN | 687 | 1e−48 | 81 |
| 2945 | 550 | 701065707H1 | SOYMON034 | g1814402 | BLASTN | 443 | 1e−47 | 84 |
| 2946 | 550 | 700962114H1 | SOYMON022 | g886470 | BLASTN | 678 | 1e−47 | 84 |
| 2947 | 550 | 700831826H1 | SOYMON019 | g2738247 | BLASTN | 682 | 1e−47 | 77 |
| 2948 | 550 | 701054296H1 | SOYMON032 | g886470 | BLASTN | 454 | 1e−46 | 83 |
| 2949 | 550 | 700888738H1 | SOYMON024 | g974781 | BLASTN | 552 | 1e−46 | 77 |
| 2950 | 550 | 700892022H1 | SOYMON024 | g886470 | BLASTN | 605 | 1e−46 | 81 |
| 2951 | 550 | 700890275H1 | SOYMON024 | g2738247 | BLASTN | 666 | 1e−46 | 77 |
| 2952 | 550 | LIB3051-006-Q1-K1-G9 | LIB3051 | g974781 | BLASTN | 670 | 1e−45 | 80 |
| 2953 | 550 | 700889113H1 | SOYMON024 | g886470 | BLASTN | 582 | 1e−43 | 81 |
| 2954 | 550 | 700952720H1 | SOYMON022 | g886470 | BLASTN | 611 | 1e−42 | 76 |
| 2955 | 550 | 701014761H1 | SOYMON019 | g886470 | BLASTN | 318 | 1e−41 | 84 |
| 2956 | 550 | 700753882H1 | SOYMON014 | g886470 | BLASTN | 381 | 1e−41 | 79 |
| 2957 | 550 | 700743792H1 | SOYMON012 | g1814402 | BLASTN | 610 | 1e−41 | 86 |
| 2958 | 550 | 700990963H1 | SOYMON011 | g886470 | BLASTN | 578 | 1e−39 | 77 |
| 2959 | 550 | 700941880H1 | SOYMON024 | g2738247 | BLASTN | 583 | 1e−39 | 81 |
| 2960 | 550 | 700898962H1 | SOYMON027 | g2738247 | BLASTN | 571 | 1e−38 | 80 |
| 2961 | 550 | 700990865H1 | SOYMON011 | g2738247 | BLASTN | 467 | 1e−37 | 77 |
| 2962 | 550 | 700565779H1 | SOYMON002 | g886470 | BLASTN | 557 | 1e−37 | 70 |
| 2963 | 550 | 700993903H1 | SOYMON011 | g974781 | BLASTN | 562 | 1e−37 | 84 |
| 2964 | 550 | 700941589H1 | SOYMON024 | g2738247 | BLASTN | 550 | 1e−36 | 81 |
| 2965 | 550 | 701052554H1 | SOYMON032 | g886470 | BLASTN | 534 | 1e−35 | 67 |
| 2966 | 550 | 700991055H1 | SOYMON011 | g886470 | BLASTN | 356 | 1e−34 | 79 |
| 2967 | 550 | 701010438H1 | SOYMON019 | g2738247 | BLASTN | 508 | 1e−33 | 79 |
| 2968 | 550 | 700756634H1 | SOYMON014 | g2738247 | BLASTN | 494 | 1e−32 | 76 |
| 2969 | 550 | 701042980H1 | SOYMON029 | g886470 | BLASTN | 461 | 1e−29 | 83 |
| 2970 | 550 | 700682940H1 | SOYMON008 | g2738247 | BLASTN | 466 | 1e−29 | 83 |
| 2971 | 550 | 701049575H1 | SOYMON032 | g886470 | BLASTN | 433 | 1e−27 | 82 |
| 2972 | 550 | 700982552H1 | SOYMON009 | g886470 | BLASTN | 356 | 1e−25 | 78 |
| 2973 | 550 | 700675637H1 | SOYMON007 | g886470 | BLASTN | 375 | 1e−25 | 79 |
| 2974 | 550 | 701142153H1 | SOYMON038 | g886470 | BLASTN | 377 | 1e−22 | 76 |
| 2975 | 550 | 700682724H1 | SOYMON008 | g974781 | BLASTN | 361 | 1e−19 | 88 |
| 2976 | 550 | 701051764H1 | SOYMON032 | g1814402 | BLASTN | 211 | 1e−17 | 80 |
| 2977 | 550 | 700867241H1 | SOYMON016 | g2738248 | BLASTX | 152 | 1e−13 | 88 |
| 2978 | 550 | 701054954H1 | SOYMON032 | g2738248 | BLASTX | 138 | 1e−12 | 86 |
| 2979 | 550 | 700790450H2 | SOYMON011 | g974781 | BLASTN | 238 | 1e−10 | 80 |
| 2980 | 550 | 700653979H1 | SOYMON003 | g1814403 | BLASTX | 118 | 1e−9 | 92 |
| 2981 | 550 | 700894218H1 | SOYMON024 | g2738248 | BLASTX | 122 | 1e−9 | 78 |
| 2982 | 550 | 700863078H1 | SOYMON022 | g2738247 | BLASTN | 236 | 1e−8 | 78 |
| 2983 | 5758 | 701209304H1 | SOYMON035 | g886470 | BLASTN | 766 | 1e−54 | 84 |
| 2984 | 5758 | 701106455H1 | SOYMON036 | g886470 | BLASTN | 723 | 1e−51 | 82 |
| 2985 | 5758 | 700833538H1 | SOYMON019 | g1814402 | BLASTN | 609 | 1e−43 | 83 |
| 2986 | 5758 | 701051425H1 | SOYMON032 | g886470 | BLASTN | 629 | 1e−43 | 83 |
| 2987 | 5758 | 700654506H1 | SOYMON004 | g886470 | BLASTN | 438 | 1e−26 | 70 |
| 2988 | 5758 | 701047795H1 | SOYMON032 | g974782 | BLASTX | 161 | 1e−15 | 100 |
| 2989 | 5758 | 701202409H1 | SOYMON035 | g1814402 | BLASTN | 310 | 1e−15 | 79 |
| 2990 | 8266 | 700558628H1 | SOYMON001 | g886470 | BLASTN | 780 | 1e−56 | 74 |
| 2991 | 8266 | 701207720H1 | SOYMON035 | g1814402 | BLASTN | 766 | 1e−54 | 74 |
| 2992 | 8266 | 700557429H1 | SOYMON001 | g1814402 | BLASTN | 728 | 1e−51 | 75 |

ADENOSYLHOMOCYSTEINASE (EC 3.3.1.1)

| Seq No. | Cluster ID | CloneID | Library | NCBI gi | Method | Score | P-value | % Ident |
|---|---|---|---|---|---|---|---|---|
| 1354 | -700154280 | 700154280H1 | SATMON007 | g170772 | BLASTN | 229 | 1e−23 | 77 |
| 1355 | -L30594291 | LIB3059-032-Q1-K1-A8 | LIB3059 | g170772 | BLASTN | 516 | 1e−74 | 73 |

-continued

ADENOSYLHOMOCYSTEINASE (EC 3.3.1.1)

| Seq No. | Cluster ID | CloneID | Library | NCBI gi | Method | Score | P-value | % Ident |
|---|---|---|---|---|---|---|---|---|
| 1356 | -L30664307 | LIB3066-047-Q1-K1-E7 | LIB3066 | g170772 | BLASTN | 628 | 1e-49 | 70 |
| 1357 | 503 | LIB3079-013-Q1-K1-D3 | LIB3079 | g170772 | BLASTN | 1505 | 1e-139 | 89 |
| 1358 | 503 | LIB3062-017-Q1-K1-A10 | LIB3062 | g170772 | BLASTN | 1571 | 1e-129 | 89 |
| 1359 | 503 | LIB3067-001-Q1-K1-D11 | LIB3067 | g170772 | BLASTN | 1654 | 1e-129 | 89 |
| 1360 | 503 | LIB148-060-Q1-E1-B9 | LIB148 | g170772 | BLASTN | 1620 | 1e-126 | 90 |
| 1361 | 503 | LIB3069-043-Q1-K1-G4 | LIB3069 | g170772 | BLASTN | 1360 | 1e-124 | 84 |
| 1362 | 503 | LIB143-006-Q1-E1-F3 | LIB143 | g170772 | BLASTN | 831 | 1e-120 | 88 |
| 1363 | 503 | LIB189-009-Q1-E1-E9 | LIB189 | g170772 | BLASTN | 1551 | 1e-120 | 90 |
| 1364 | 503 | LIB3060-003-Q1-K1-F9 | LIB3060 | g170772 | BLASTN | 1538 | 1e-119 | 91 |
| 1365 | 503 | 700089023H1 | SATMON011 | g170772 | BLASTN | 1495 | 1e-115 | 91 |
| 1366 | 503 | LIB143-061-Q1-E1-C9 | LIB143 | g170772 | BLASTN | 1474 | 1e-114 | 90 |
| 1367 | 503 | LIB3069-034-Q1-K1-E5 | LIB3069 | g170772 | BLASTN | 1483 | 1e-114 | 88 |
| 1368 | 503 | LIB143-061-Q1-E1-E5 | LIB143 | g170772 | BLASTN | 1440 | 1e-113 | 89 |
| 1369 | 503 | LIB3067-040-Q1-K1-H5 | LIB3067 | g170772 | BLASTN | 1467 | 1e-113 | 88 |
| 1370 | 503 | LIB3067-048-Q1-K1-A11 | LIB3067 | g170772 | BLASTN | 1207 | 1e-109 | 86 |
| 1371 | 503 | LIB3068-050-Q1-K1-G6 | LIB3068 | g170772 | BLASTN | 1279 | 1e-109 | 86 |
| 1372 | 503 | LIB3069-036-Q1-K1-F6 | LIB3069 | g170772 | BLASTN | 1310 | 1e-109 | 92 |
| 1373 | 503 | LIB3066-047-Q1-K1-H5 | LIB3066 | g170772 | BLASTN | 1353 | 1e-108 | 86 |
| 1374 | 503 | LIB3059-011-Q1-K1-A5 | LIB3059 | g170772 | BLASTN | 1401 | 1e-107 | 90 |
| 1375 | 503 | LIB3067-056-Q1-K1-E11 | LIB3067 | g170772 | BLASTN | 957 | 1e-106 | 86 |
| 1376 | 503 | LIB189-010-Q1-E1-E12 | LIB189 | g170772 | BLASTN | 1144 | 1e-106 | 88 |
| 1377 | 503 | 700084426H1 | SATMON011 | g170772 | BLASTN | 1368 | 1e-105 | 91 |
| 1378 | 503 | 700086273H1 | SATMON011 | g170772 | BLASTN | 1364 | 1e-104 | 91 |
| 1379 | 503 | 700573027H1 | SATMON030 | g170772 | BLASTN | 939 | 1e-103 | 89 |
| 1380 | 503 | 700209360H1 | SATMON016 | g170772 | BLASTN | 1350 | 1e-103 | 89 |
| 1381 | 503 | 700619916H1 | SATMON034 | g170772 | BLASTN | 1050 | 1e-102 | 89 |
| 1382 | 503 | 700086051H1 | SATMON011 | g170772 | BLASTN | 1336 | 1e-102 | 90 |
| 1383 | 503 | LIB3069-034-Q1-K1-C8 | LIB3069 | g170772 | BLASTN | 1322 | 1e-101 | 86 |
| 1384 | 503 | 700026324H1 | SATMON003 | g170772 | BLASTN | 1328 | 1e-101 | 91 |
| 1385 | 503 | 700104549H1 | SATMON010 | g170772 | BLASTN | 836 | 1e-100 | 88 |
| 1386 | 503 | 700622108H1 | SATMON034 | g170772 | BLASTN | 1158 | 1e-100 | 88 |
| 1387 | 503 | 700093980H1 | SATMON008 | g170772 | BLASTN | 1312 | 1e-100 | 90 |
| 1388 | 503 | 700077427H1 | SATMON007 | g170772 | BLASTN | 1317 | 1e-100 | 90 |
| 1389 | 503 | 700095389H1 | SATMON008 | g170772 | BLASTN | 1302 | 1e-99 | 91 |
| 1390 | 503 | LIB3067-055-Q1-K1-D3 | LIB3067 | g170772 | BLASTN | 762 | 1e-98 | 87 |
| 1391 | 503 | LIB3060-054-Q1-K1-F6 | LIB3060 | g170772 | BLASTN | 1009 | 1e-98 | 83 |
| 1392 | 503 | 700083339H1 | SATMON011 | g170772 | BLASTN | 1282 | 1e-98 | 91 |
| 1393 | 503 | 700102631H1 | SATMON010 | g170772 | BLASTN | 1283 | 1e-98 | 89 |
| 1394 | 503 | 700265625H1 | SATMON017 | g170772 | BLASTN | 1286 | 1e-98 | 90 |
| 1395 | 503 | 700095002H1 | SATMON008 | g170772 | BLASTN | 1289 | 1e-98 | 88 |
| 1396 | 503 | 700094761H1 | SATMON008 | g170772 | BLASTN | 1289 | 1e-98 | 88 |
| 1397 | 503 | 700073832H1 | SATMON007 | g170772 | BLASTN | 1270 | 1e-97 | 88 |
| 1398 | 503 | 700047817H1 | SATMON003 | g170772 | BLASTN | 1272 | 1e-97 | 91 |
| 1399 | 503 | 700091149H1 | SATMON011 | g170772 | BLASTN | 1262 | 1e-96 | 89 |
| 1400 | 503 | 700098584H1 | SATMON009 | g170772 | BLASTN | 1264 | 1e-96 | 91 |
| 1401 | 503 | 700085932H1 | SATMON011 | g170772 | BLASTN | 1266 | 1e-96 | 89 |
| 1402 | 503 | 700094081H1 | SATMON008 | g170772 | BLASTN | 1269 | 1e-96 | 91 |
| 1403 | 503 | 700202442H1 | SATMON003 | g170772 | BLASTN | 1145 | 1e-95 | 88 |
| 1404 | 503 | 700049770H1 | SATMON003 | g170772 | BLASTN | 1246 | 1e-95 | 89 |
| 1405 | 503 | LIB3079-020-Q1-K1-B12 | LIB3079 | g170772 | BLASTN | 1249 | 1e-95 | 85 |
| 1406 | 503 | 700090226H1 | SATMON011 | g170772 | BLASTN | 1252 | 1e-95 | 90 |
| 1407 | 503 | 700088191H1 | SATMON011 | g170772 | BLASTN | 1253 | 1e-95 | 90 |
| 1408 | 503 | 700076743H1 | SATMON007 | g170772 | BLASTN | 1256 | 1e-95 | 90 |
| 1409 | 503 | LIB189-009-Q1-E1-E10 | LIB189 | g170772 | BLASTN | 789 | 1e-94 | 88 |
| 1410 | 503 | 700072038H1 | SATMON007 | g170772 | BLASTN | 1237 | 1e-94 | 89 |
| 1411 | 503 | 700082967H1 | SATMON011 | g170772 | BLASTN | 1239 | 1e-94 | 89 |
| 1412 | 503 | LIB3068-062-Q1-K1-A3 | LIB3068 | g170772 | BLASTN | 1148 | 1e-93 | 82 |
| 1413 | 503 | 700094713H1 | SATMON008 | g170772 | BLASTN | 1222 | 1e-93 | 88 |
| 1414 | 503 | 700095620H1 | SATMON008 | g170772 | BLASTN | 1173 | 1e-92 | 89 |
| 1415 | 503 | 700242509H1 | SATMON010 | g170772 | BLASTN | 1213 | 1e-92 | 92 |
| 1416 | 503 | 700071923H1 | SATMON007 | g170772 | BLASTN | 1214 | 1e-92 | 90 |
| 1417 | 503 | 700575314H1 | SATMON030 | g170772 | BLASTN | 1149 | 1e-91 | 88 |
| 1418 | 503 | 700086654H1 | SATMON011 | g170772 | BLASTN | 1199 | 1e-91 | 90 |
| 1419 | 503 | 700241072H1 | SATMON010 | g170772 | BLASTN | 1205 | 1e-91 | 91 |
| 1420 | 503 | 700047361H1 | SATMON003 | g170772 | BLASTN | 1110 | 1e-90 | 89 |
| 1421 | 503 | 700217056H1 | SATMON016 | g170772 | BLASTN | 1187 | 1e-90 | 91 |
| 1422 | 503 | LIB3067-005-Q1-K1-F2 | LIB3067 | g170772 | BLASTN | 1188 | 1e-90 | 84 |
| 1423 | 503 | 700075495H1 | SATMON007 | g170772 | BLASTN | 1193 | 1e-90 | 86 |
| 1424 | 503 | 700084783H1 | SATMON011 | g170772 | BLASTN | 1194 | 1e-90 | 91 |
| 1425 | 503 | LIB143-059-Q1-E1-C3 | LIB143 | g170772 | BLASTN | 952 | 1e-89 | 84 |
| 1426 | 503 | 700448818H1 | SATMON028 | g170772 | BLASTN | 1174 | 1e-89 | 91 |
| 1427 | 503 | 700159079H1 | SATMON012 | g170772 | BLASTN | 1177 | 1e-89 | 92 |
| 1428 | 503 | 700094408H1 | SATMON008 | g170772 | BLASTN | 1177 | 1e-89 | 92 |
| 1429 | 503 | 700348440H1 | SATMON023 | g170772 | BLASTN | 1182 | 1e-89 | 89 |

-continued

ADENOSYLHOMOCYSTEINASE (EC 3.3.1.1)

| Seq No. | Cluster ID | CloneID | Library | NCBI gi | Method | Score | P-value | % Ident |
|---|---|---|---|---|---|---|---|---|
| 1430 | 503 | 700077082H1 | SATMON007 | g170772 | BLASTN | 1182 | 1e−89 | 92 |
| 1431 | 503 | 700082111H1 | SATMON011 | g170772 | BLASTN | 1183 | 1e−89 | 89 |
| 1432 | 503 | 700239752H1 | SATMON010 | g170772 | BLASTN | 1164 | 1e−88 | 89 |
| 1433 | 503 | 700029456H1 | SATMON003 | g170772 | BLASTN | 1166 | 1e−88 | 90 |
| 1434 | 503 | 700209430H1 | SATMON016 | g170772 | BLASTN | 1170 | 1e−88 | 90 |
| 1435 | 503 | 700208660H1 | SATMON016 | g170772 | BLASTN | 930 | 1e−87 | 90 |
| 1436 | 503 | 700213138H1 | SATMON016 | g170772 | BLASTN | 1042 | 1e−87 | 89 |
| 1437 | 503 | 700102234H1 | SATMON010 | g170772 | BLASTN | 634 | 1e−85 | 90 |
| 1438 | 503 | 700450479H1 | SATMON028 | g170772 | BLASTN | 1015 | 1e−85 | 90 |
| 1439 | 503 | 700095372H1 | SATMON008 | g170772 | BLASTN | 1126 | 1e−85 | 90 |
| 1440 | 503 | 700218734H1 | SATMON011 | g170772 | BLASTN | 1128 | 1e−85 | 94 |
| 1441 | 503 | 700256858H1 | SATMON017 | g170772 | BLASTN | 1133 | 1e−85 | 90 |
| 1442 | 503 | 700221063H1 | SATMON011 | g170772 | BLASTN | 1137 | 1e−85 | 90 |
| 1443 | 503 | 700105439H1 | SATMON010 | g170772 | BLASTN | 1118 | 1e−84 | 89 |
| 1444 | 503 | 700085174H1 | SATMON011 | g170772 | BLASTN | 1125 | 1e−84 | 90 |
| 1445 | 503 | 700242421H1 | SATMON010 | g170772 | BLASTN | 1125 | 1e−84 | 92 |
| 1446 | 503 | 700074492H1 | SATMON007 | g170772 | BLASTN | 774 | 1e−83 | 88 |
| 1447 | 503 | 700209295H1 | SATMON016 | g170772 | BLASTN | 914 | 1e−83 | 89 |
| 1448 | 503 | 700455826H1 | SATMON029 | g170772 | BLASTN | 978 | 1e−83 | 91 |
| 1449 | 503 | 700213370H1 | SATMON016 | g170772 | BLASTN | 1110 | 1e−83 | 92 |
| 1450 | 503 | 700352095H1 | SATMON023 | g170772 | BLASTN | 1111 | 1e−83 | 89 |
| 1451 | 503 | 700076842H1 | SATMON007 | g170772 | BLASTN | 1112 | 1e−83 | 90 |
| 1452 | 503 | 700215872H1 | SATMON016 | g170772 | BLASTN | 1113 | 1e−83 | 89 |
| 1453 | 503 | 700073645H1 | SATMON007 | g170772 | BLASTN | 1113 | 1e−83 | 89 |
| 1454 | 503 | 700048153H1 | SATMON003 | g170772 | BLASTN | 651 | 1e−82 | 90 |
| 1455 | 503 | 700073307H1 | SATMON007 | g170772 | BLASTN | 762 | 1e−82 | 90 |
| 1456 | 503 | 700350009H1 | SATMON023 | g170772 | BLASTN | 924 | 1e−82 | 88 |
| 1457 | 503 | LIB143-059-Q1-E1-C5 | LIB143 | g170772 | BLASTN | 1029 | 1e−82 | 83 |
| 1458 | 503 | 700073955H1 | SATMON007 | g170772 | BLASTN | 1090 | 1e−82 | 90 |
| 1459 | 503 | LIB3059-042-Q1-K1-H12 | LIB3059 | g170772 | BLASTN | 1090 | 1e−82 | 85 |
| 1460 | 503 | 700238024H1 | SATMON010 | g170772 | BLASTN | 1091 | 1e−82 | 90 |
| 1461 | 503 | 700155863H1 | SATMON007 | g170772 | BLASTN | 1091 | 1e−82 | 93 |
| 1462 | 503 | 700217890H1 | SATMON016 | g170772 | BLASTN | 1093 | 1e−82 | 91 |
| 1463 | 503 | 700239314H1 | SATMON010 | g170772 | BLASTN | 1094 | 1e−82 | 88 |
| 1464 | 503 | 700048337H1 | SATMON003 | g170772 | BLASTN | 1094 | 1e−82 | 92 |
| 1465 | 503 | 700235469H1 | SATMON010 | g170772 | BLASTN | 1098 | 1e−82 | 91 |
| 1466 | 503 | 700164224H1 | SATMON013 | g170772 | BLASTN | 710 | 1e−81 | 92 |
| 1467 | 503 | 700209374H1 | SATMON016 | g170772 | BLASTN | 1083 | 1e−81 | 89 |
| 1468 | 503 | 700082268H1 | SATMON011 | g170772 | BLASTN | 1083 | 1e−81 | 88 |
| 1469 | 503 | 700159326H1 | SATMON012 | g170772 | BLASTN | 777 | 1e−80 | 91 |
| 1470 | 503 | 700025934H1 | SATMON003 | g170772 | BLASTN | 792 | 1e−80 | 91 |
| 1471 | 503 | 700210458H1 | SATMON016 | g170772 | BLASTN | 856 | 1e−80 | 88 |
| 1472 | 503 | 700243826H1 | SATMON010 | g170772 | BLASTN | 881 | 1e−80 | 90 |
| 1473 | 503 | 700242676H1 | SATMON010 | g170772 | BLASTN | 940 | 1e−80 | 89 |
| 1474 | 503 | 700345565H1 | SATMON021 | g170772 | BLASTN | 1034 | 1e−80 | 89 |
| 1475 | 503 | 700264733H1 | SATMON017 | g170772 | BLASTN | 1044 | 1e−80 | 90 |
| 1476 | 503 | 700159161H1 | SATMON012 | g170772 | BLASTN | 1068 | 1e−80 | 90 |
| 1477 | 503 | 700072491H1 | SATMON007 | g170772 | BLASTN | 604 | 1e−79 | 88 |
| 1478 | 503 | 700053204H1 | SATMON008 | g170772 | BLASTN | 618 | 1e−79 | 89 |
| 1479 | 503 | 700451515H1 | SATMON028 | g170772 | BLASTN | 1057 | 1e−79 | 85 |
| 1480 | 503 | 700468929H1 | SATMON025 | g170772 | BLASTN | 1061 | 1e−79 | 84 |
| 1481 | 503 | 700205801H1 | SATMON003 | g170772 | BLASTN | 1064 | 1e−79 | 91 |
| 1482 | 503 | 700611326H1 | SATMON022 | g170772 | BLASTN | 725 | 1e−78 | 88 |
| 1483 | 503 | 700082291H1 | SATMON011 | g170772 | BLASTN | 1043 | 1e−78 | 87 |
| 1484 | 503 | 700071695H1 | SATMON007 | g170772 | BLASTN | 1048 | 1e−78 | 89 |
| 1485 | 503 | 700551561H1 | SATMON022 | g170772 | BLASTN | 746 | 1e−77 | 88 |
| 1486 | 503 | 700221019H1 | SATMON011 | g170772 | BLASTN | 856 | 1e−77 | 89 |
| 1487 | 503 | LIB3078-007-Q1-K1-C5 | LIB3078 | g170772 | BLASTN | 936 | 1e−77 | 83 |
| 1488 | 503 | 700049925H1 | SATMON003 | g170772 | BLASTN | 954 | 1e−77 | 89 |
| 1489 | 503 | 700154101H1 | SATMON007 | g170772 | BLASTN | 1036 | 1e−77 | 88 |
| 1490 | 503 | 700380151H1 | SATMON021 | g170772 | BLASTN | 613 | 1e−76 | 88 |
| 1491 | 503 | 700243831H1 | SATMON010 | g170772 | BLASTN | 842 | 1e−76 | 89 |
| 1492 | 503 | 700235671H1 | SATMON010 | g170772 | BLASTN | 1019 | 1e−76 | 90 |
| 1493 | 503 | 700087847H1 | SATMON011 | g170772 | BLASTN | 1009 | 1e−75 | 82 |
| 1494 | 503 | 700208747H1 | SATMON016 | g170772 | BLASTN | 1010 | 1e−75 | 89 |
| 1495 | 503 | 700071795H1 | SATMON007 | g170772 | BLASTN | 1011 | 1e−75 | 89 |
| 1496 | 503 | 700157002H1 | SATMON012 | g170772 | BLASTN | 1012 | 1e−75 | 90 |
| 1497 | 503 | 700201608H1 | SATMON003 | g170772 | BLASTN | 1015 | 1e−75 | 85 |
| 1498 | 503 | 700451541H1 | SATMON028 | g170772 | BLASTN | 1015 | 1e−75 | 86 |
| 1499 | 503 | 700212182H1 | SATMON016 | g170772 | BLASTN | 1015 | 1e−75 | 88 |
| 1500 | 503 | 700381485H1 | SATMON023 | g170772 | BLASTN | 1017 | 1e−75 | 91 |
| 1501 | 503 | 700096793H1 | SATMON008 | g170772 | BLASTN | 761 | 1e−74 | 87 |
| 1502 | 503 | 700093025H1 | SATMON008 | g170772 | BLASTN | 996 | 1e−74 | 89 |
| 1503 | 503 | 700017129H1 | SATMON001 | g170772 | BLASTN | 998 | 1e−74 | 92 |

-continued

ADENOSYLHOMOCYSTEINASE (EC 3.3.1.1)

| Seq No. | Cluster ID | CloneID | Library | NCBI gi | Method | Score | P-value | % Ident |
|---|---|---|---|---|---|---|---|---|
| 1504 | 503 | 700216525H1 | SATMON016 | g170772 | BLASTN | 1000 | 1e−74 | 86 |
| 1505 | 503 | 700087912H1 | SATMON011 | g170772 | BLASTN | 1001 | 1e−74 | 91 |
| 1506 | 503 | 700172618H1 | SATMON013 | g170772 | BLASTN | 1001 | 1e−74 | 91 |
| 1507 | 503 | 700801894H1 | SATMON036 | g170772 | BLASTN | 1002 | 1e−74 | 90 |
| 1508 | 503 | 700162040H1 | SATMON012 | g170772 | BLASTN | 1003 | 1e−74 | 92 |
| 1509 | 503 | 700212084H1 | SATMON016 | g170772 | BLASTN | 1004 | 1e−74 | 89 |
| 1510 | 503 | 700027971H1 | SATMON003 | g170772 | BLASTN | 982 | 1e−73 | 92 |
| 1511 | 503 | 700077321H1 | SATMON007 | g170772 | BLASTN | 985 | 1e−73 | 89 |
| 1512 | 503 | 700619884H1 | SATMON034 | g170772 | BLASTN | 987 | 1e−73 | 87 |
| 1513 | 503 | 700457201H1 | SATMON029 | g170772 | BLASTN | 988 | 1e−73 | 87 |
| 1514 | 503 | 700082970H1 | SATMON011 | g170772 | BLASTN | 990 | 1e−73 | 89 |
| 1515 | 503 | 700083350H1 | SATMON011 | g170772 | BLASTN | 971 | 1e−72 | 89 |
| 1516 | 503 | 700017732H1 | SATMON001 | g170772 | BLASTN | 973 | 1e−72 | 88 |
| 1517 | 503 | 700094688H1 | SATMON008 | g170772 | BLASTN | 975 | 1e−72 | 89 |
| 1518 | 503 | 700170985H1 | SATMON013 | g170772 | BLASTN | 979 | 1e−72 | 89 |
| 1519 | 503 | 700451847H1 | SATMON028 | g170772 | BLASTN | 872 | 1e−71 | 84 |
| 1520 | 503 | 700455091H1 | SATMON029 | g170772 | BLASTN | 931 | 1e−71 | 93 |
| 1521 | 503 | 700106189H1 | SATMON010 | g170772 | BLASTN | 960 | 1e−71 | 88 |
| 1522 | 503 | 700160075H1 | SATMON012 | g170772 | BLASTN | 968 | 1e−71 | 90 |
| 1523 | 503 | 700084952H1 | SATMON011 | g170772 | BLASTN | 552 | 1e−70 | 78 |
| 1524 | 503 | 700348238H1 | SATMON023 | g170772 | BLASTN | 946 | 1e−70 | 87 |
| 1525 | 503 | 700151310H1 | SATMON007 | g170772 | BLASTN | 948 | 1e−70 | 90 |
| 1526 | 503 | 700048962H1 | SATMON003 | g170772 | BLASTN | 677 | 1e−69 | 88 |
| 1527 | 503 | 700088485H1 | SATMON011 | g170772 | BLASTN | 936 | 1e−69 | 88 |
| 1528 | 503 | 700093667H1 | SATMON008 | g170772 | BLASTN | 937 | 1e−69 | 88 |
| 1529 | 503 | 700164491H1 | SATMON012 | g170772 | BLASTN | 928 | 1e−68 | 86 |
| 1530 | 503 | 700073939H1 | SATMON007 | g170772 | BLASTN | 931 | 1e−68 | 88 |
| 1531 | 503 | 700027715H1 | SATMON003 | g170772 | BLASTN | 472 | 1e−67 | 90 |
| 1532 | 503 | 700072843H1 | SATMON007 | g170772 | BLASTN | 692 | 1e−67 | 87 |
| 1533 | 503 | 700439356H1 | SATMON026 | g170772 | BLASTN | 777 | 1e−67 | 85 |
| 1534 | 503 | 700073556H1 | SATMON007 | g170772 | BLASTN | 910 | 1e−67 | 88 |
| 1535 | 503 | 700154461H1 | SATMON007 | g170772 | BLASTN | 911 | 1e−67 | 87 |
| 1536 | 503 | 700201909H1 | SATMON003 | g170772 | BLASTN | 912 | 1e−67 | 88 |
| 1537 | 503 | 700104384H1 | SATMON010 | g170772 | BLASTN | 665 | 1e−66 | 89 |
| 1538 | 503 | 700152707H1 | SATMON007 | g170772 | BLASTN | 898 | 1e−66 | 88 |
| 1539 | 503 | 700076625H1 | SATMON007 | g170772 | BLASTN | 900 | 1e−66 | 85 |
| 1540 | 503 | 700456945H1 | SATMON029 | g170772 | BLASTN | 902 | 1e−66 | 80 |
| 1541 | 503 | 700457294H1 | SATMON029 | g170772 | BLASTN | 446 | 1e−65 | 88 |
| 1542 | 503 | 700152062H1 | SATMON007 | g170772 | BLASTN | 803 | 1e−65 | 90 |
| 1543 | 503 | 700072428H2 | SATMON007 | g170772 | BLASTN | 890 | 1e−65 | 88 |
| 1544 | 503 | 700217352H1 | SATMON016 | g170772 | BLASTN | 893 | 1e−65 | 88 |
| 1545 | 503 | 700072443H2 | SATMON007 | g170772 | BLASTN | 894 | 1e−65 | 89 |
| 1546 | 503 | 700087436H1 | SATMON011 | g170772 | BLASTN | 874 | 1e−64 | 88 |
| 1547 | 503 | 700240615H1 | SATMON010 | g170772 | BLASTN | 877 | 1e−64 | 88 |
| 1548 | 503 | 700155233H1 | SATMON007 | g170772 | BLASTN | 883 | 1e−64 | 90 |
| 1549 | 503 | 700241210H1 | SATMON010 | g170772 | BLASTN | 822 | 1e−63 | 87 |
| 1550 | 503 | 700478070H1 | SATMON025 | g170772 | BLASTN | 863 | 1e−63 | 82 |
| 1551 | 503 | 700447433H1 | SATMON027 | g170772 | BLASTN | 865 | 1e−63 | 84 |
| 1552 | 503 | 700215884H1 | SATMON016 | g170772 | BLASTN | 865 | 1e−63 | 88 |
| 1553 | 503 | 700575250H1 | SATMON030 | g170772 | BLASTN | 820 | 1e−61 | 84 |
| 1554 | 503 | 700209283H1 | SATMON016 | g170772 | BLASTN | 833 | 1e−60 | 86 |
| 1555 | 503 | 700213479H1 | SATMON016 | g170772 | BLASTN | 834 | 1e−60 | 88 |
| 1556 | 503 | 700241740H1 | SATMON010 | g170772 | BLASTN | 814 | 1e−59 | 88 |
| 1557 | 503 | 700026012H1 | SATMON003 | g170772 | BLASTN | 815 | 1e−59 | 87 |
| 1558 | 503 | 700151036H1 | SATMON007 | g170772 | BLASTN | 816 | 1e−59 | 91 |
| 1559 | 503 | 700207150H1 | SATMON017 | g170772 | BLASTN | 818 | 1e−59 | 87 |
| 1560 | 503 | 700217383H1 | SATMON016 | g170772 | BLASTN | 824 | 1e−59 | 88 |
| 1561 | 503 | 700618168H1 | SATMON033 | g170772 | BLASTN | 385 | 1e−58 | 80 |
| 1562 | 503 | 700020777H1 | SATMON001 | g170772 | BLASTN | 806 | 1e−58 | 85 |
| 1563 | 503 | 700224131H1 | SATMON011 | g170772 | BLASTN | 794 | 1e−57 | 88 |
| 1564 | 503 | 700222876H1 | SATMON011 | g170772 | BLASTN | 794 | 1e−57 | 88 |
| 1565 | 503 | 700027716H1 | SATMON003 | g170772 | BLASTN | 642 | 1e−56 | 79 |
| 1566 | 503 | 700073305H1 | SATMON007 | g170772 | BLASTN | 787 | 1e−56 | 83 |
| 1567 | 503 | 700257376H1 | SATMON017 | g170772 | BLASTN | 362 | 1e−55 | 87 |
| 1568 | 503 | 700151752H1 | SATMON007 | g170772 | BLASTN | 766 | 1e−55 | 89 |
| 1569 | 503 | 700219086H1 | SATMON011 | g170772 | BLASTN | 769 | 1e−55 | 87 |
| 1570 | 503 | 700218924H1 | SATMON011 | g170772 | BLASTN | 775 | 1e−55 | 87 |
| 1571 | 503 | 700424527H1 | SATMONN01 | g170772 | BLASTN | 777 | 1e−55 | 83 |
| 1572 | 503 | 700073183H1 | SATMON007 | g170772 | BLASTN | 607 | 1e−54 | 85 |
| 1573 | 503 | 700217412H1 | SATMON016 | g170772 | BLASTN | 755 | 1e−54 | 87 |
| 1574 | 503 | 700208634H1 | SATMON016 | g170772 | BLASTN | 642 | 1e−53 | 83 |
| 1575 | 503 | 700202577H1 | SATMON003 | g170772 | BLASTN | 743 | 1e−53 | 86 |
| 1576 | 503 | 700446645H1 | SATMON027 | g170772 | BLASTN | 744 | 1e−53 | 87 |
| 1577 | 503 | 700238061H1 | SATMON010 | g170772 | BLASTN | 745 | 1e−53 | 86 |

-continued

ADENOSYLHOMOCYSTEINASE (EC 3.3.1.1)

| Seq No. | Cluster ID | CloneID | Library | NCBI gi | Method | Score | P-value | % Ident |
|---|---|---|---|---|---|---|---|---|
| 1578 | 503 | 700617325H1 | SATMON033 | g170772 | BLASTN | 751 | 1e−53 | 91 |
| 1579 | 503 | 700239901H1 | SATMON010 | g170772 | BLASTN | 641 | 1e−52 | 86 |
| 1580 | 503 | 700155130H1 | SATMON007 | g170772 | BLASTN | 646 | 1e−52 | 88 |
| 1581 | 503 | 700083360H1 | SATMON011 | g170772 | BLASTN | 739 | 1e−52 | 87 |
| 1582 | 503 | 700236915H1 | SATMON010 | g170772 | BLASTN | 740 | 1e−52 | 87 |
| 1583 | 503 | 700074780H1 | SATMON007 | g170772 | BLASTN | 528 | 1e−51 | 83 |
| 1584 | 503 | 700479515H1 | SATMON034 | g170772 | BLASTN | 718 | 1e−51 | 88 |
| 1585 | 503 | 700215545H1 | SATMON016 | g170772 | BLASTN | 724 | 1e−51 | 90 |
| 1586 | 503 | 700165354H1 | SATMON013 | g170772 | BLASTN | 728 | 1e−51 | 86 |
| 1587 | 503 | 700353994H1 | SATMON024 | g170772 | BLASTN | 713 | 1e−50 | 87 |
| 1588 | 503 | 700153619H1 | SATMON007 | g170772 | BLASTN | 694 | 1e−49 | 86 |
| 1589 | 503 | 700074779H1 | SATMON007 | g170772 | BLASTN | 705 | 1e−49 | 77 |
| 1590 | 503 | 700155530H1 | SATMON007 | g170772 | BLASTN | 686 | 1e−48 | 86 |
| 1591 | 503 | 700221207H1 | SATMON011 | g170772 | BLASTN | 692 | 1e−48 | 86 |
| 1592 | 503 | 700264257H1 | SATMON017 | g170772 | BLASTN | 672 | 1e−47 | 87 |
| 1593 | 503 | 700152216H1 | SATMON007 | g170772 | BLASTN | 659 | 1e−46 | 88 |
| 1594 | 503 | 700150643H1 | SATMON007 | g170772 | BLASTN | 659 | 1e−46 | 88 |
| 1595 | 503 | 700156027H1 | SATMON007 | g170772 | BLASTN | 655 | 1e−45 | 93 |
| 1596 | 503 | 700260335H1 | SATMON017 | g170772 | BLASTN | 385 | 1e−44 | 79 |
| 1597 | 503 | 700623795H1 | SATMON034 | g170772 | BLASTN | 401 | 1e−44 | 88 |
| 1598 | 503 | 700150581H1 | SATMON007 | g170772 | BLASTN | 640 | 1e−44 | 88 |
| 1599 | 503 | 700151970H1 | SATMON007 | g170772 | BLASTN | 645 | 1e−44 | 87 |
| 1600 | 503 | 700151780H1 | SATMON007 | g170772 | BLASTN | 628 | 1e−43 | 88 |
| 1601 | 503 | 700575547H1 | SATMON030 | g170772 | BLASTN | 614 | 1e−42 | 90 |
| 1602 | 503 | LIB143-026-Q1-E1-A5 | LIB143 | g170772 | BLASTN | 633 | 1e−42 | 77 |
| 1603 | 503 | 700347945H1 | SATMON023 | g170772 | BLASTN | 586 | 1e−40 | 84 |
| 1604 | 503 | 700074416H1 | SATMON007 | g170772 | BLASTN | 589 | 1e−40 | 86 |
| 1605 | 503 | 700352990H1 | SATMON024 | g170772 | BLASTN | 575 | 1e−39 | 92 |
| 1606 | 503 | 700156025H1 | SATMON007 | g170772 | BLASTN | 568 | 1e−38 | 91 |
| 1607 | 503 | 700432072H1 | SATMONN01 | g170772 | BLASTN | 374 | 1e−37 | 84 |
| 1608 | 503 | 700354249H1 | SATMON024 | g170772 | BLASTN | 528 | 1e−35 | 93 |
| 1609 | 503 | 700617977H1 | SATMON033 | g170772 | BLASTN | 535 | 1e−35 | 87 |
| 1610 | 503 | 700218312H1 | SATMON016 | g170772 | BLASTN | 236 | 1e−33 | 91 |
| 1611 | 503 | 700456080H1 | SATMON029 | g170772 | BLASTN | 513 | 1e−33 | 83 |
| 1612 | 503 | 700349395H1 | SATMON023 | g170772 | BLASTN | 500 | 1e−32 | 91 |
| 1613 | 503 | 700051637H1 | SATMON003 | g170772 | BLASTN | 249 | 1e−31 | 86 |
| 1614 | 503 | 700202153H1 | SATMON003 | g170772 | BLASTN | 474 | 1e−30 | 91 |
| 1615 | 503 | 700256951H1 | SATMON017 | g170772 | BLASTN | 454 | 1e−29 | 86 |
| 1616 | 503 | 700150542H1 | SATMON007 | g170772 | BLASTN | 343 | 1e−28 | 76 |
| 1617 | 503 | 700151629H1 | SATMON007 | g170772 | BLASTN | 445 | 1e−28 | 85 |
| 1618 | 503 | 700446654H1 | SATMON027 | g170772 | BLASTN | 437 | 1e−27 | 84 |
| 1619 | 503 | 700155814H1 | SATMON007 | g170772 | BLASTN | 428 | 1e−26 | 88 |
| 1620 | 503 | 700161019H1 | SATMON012 | g2588780 | BLASTN | 417 | 1e−25 | 92 |
| 1621 | 503 | 700377236H1 | SATMON019 | g170772 | BLASTN | 402 | 1e−24 | 84 |
| 1622 | 503 | LIB3067-036-Q1-K1-A4 | LIB3067 | g1220121 | BLASTN | 224 | 1e−22 | 84 |
| 1623 | 503 | 700158933H1 | SATMON012 | g170772 | BLASTN | 368 | 1e−21 | 90 |
| 1624 | 503 | 700155365H1 | SATMON007 | g170772 | BLASTN | 347 | 1e−20 | 91 |
| 1625 | 503 | 700405366H1 | SATMON029 | g170772 | BLASTN | 311 | 1e−17 | 88 |
| 1626 | 503 | 700159812H1 | SATMON012 | g407412 | BLASTX | 160 | 1e−15 | 96 |
| 1627 | 503 | 700209759H1 | SATMON016 | g170772 | BLASTN | 239 | 1e−15 | 90 |
| 1628 | 503 | 700154527H1 | SATMON007 | g170772 | BLASTN | 250 | 1e−12 | 92 |
| 1629 | 503 | 700449637H1 | SATMON028 | g170772 | BLASTN | 201 | 1e−10 | 78 |
| 1630 | 503 | 700096829H1 | SATMON008 | g170772 | BLASTN | 216 | 1e−9 | 89 |
| 2993 | -700661285 | 700661285H1 | SOYMON005 | g1857024 | BLASTX | 95 | 1e−12 | 100 |
| 2994 | -700750570 | 700750570H1 | SOYMON014 | g170772 | BLASTN | 414 | 1e−24 | 81 |
| 2995 | -700752735 | 700752735H1 | SOYMON014 | g170772 | BLASTN | 446 | 1e−27 | 78 |
| 2996 | -700755052 | 700755052H1 | SOYMON014 | g170772 | BLASTN | 547 | 1e−45 | 74 |
| 2997 | -700756501 | 700756501H1 | SOYMON014 | g535583 | BLASTN | 717 | 1e−50 | 84 |
| 2998 | -700831127 | 700831127H1 | SOYMON019 | g535583 | BLASTN | 862 | 1e−63 | 83 |
| 2999 | -700851779 | 700851779H1 | SOYMON023 | g170772 | BLASTN | 505 | 1e−33 | 77 |
| 3000 | -700888715 | 700888715H1 | SOYMON024 | g535583 | BLASTN | 442 | 1e−31 | 91 |
| 3001 | -700889420 | 700889420H1 | SOYMON024 | g1220121 | BLASTN | 893 | 1e−65 | 84 |
| 3002 | -700895218 | 700895218H1 | SOYMON024 | g407411 | BLASTN | 816 | 1e−59 | 83 |
| 3003 | -700941379 | 700941379H1 | SOYMON024 | g170772 | BLASTN | 424 | 1e−33 | 72 |
| 3004 | -700986855 | 700986855H1 | SOYMON009 | g170772 | BLASTN | 701 | 1e−49 | 74 |
| 3005 | -701070484 | 701070484H1 | SOYMON034 | g407411 | BLASTN | 362 | 1e−43 | 73 |
| 3006 | -701136279 | 701136279H1 | SOYMON038 | g170772 | BLASTN | 651 | 1e−56 | 80 |
| 3007 | -GM16478 | LIB3054-007-Q1-N1-G3 | LIB3054 | g2244750 | BLASTX | 70 | 1e−27 | 61 |
| 3008 | -GM23819 | LIB3040-019-Q1-E1-C5 | LIB3040 | g535583 | BLASTN | 258 | 1e−10 | 88 |
| 3009 | -GM29758 | LIB3050-016-Q1-E1-B11 | LIB3050 | g535583 | BLASTN | 391 | 1e−42 | 70 |
| 3010 | 16 | LIB3030-003-Q1-B1-B11 | LIB3030 | g3088578 | BLASTN | 1577 | 1e−122 | 87 |
| 3011 | 16 | LIB3050-023-Q1-K1-H9 | LIB3050 | g535583 | BLASTN | 1498 | 1e−116 | 86 |
| 3012 | 16 | LIB3030-003-Q1-B1-F7 | LIB3030 | g535583 | BLASTN | 1469 | 1e−113 | 86 |
| 3013 | 16 | LIB3055-005-Q1-N1-C11 | LIB3055 | g170772 | BLASTN | 1205 | 1e−109 | 84 |

-continued

ADENOSYLHOMOCYSTEINASE (EC 3.3.1.1)

| Seq No. | Cluster ID | CloneID | Library | NCBI gi | Method | Score | P-value | % Ident |
|---|---|---|---|---|---|---|---|---|
| 3014 | 16 | LIB3065-011-Q1-N1-A3 | LIB3065 | g170772 | BLASTN | 622 | 1e-107 | 88 |
| 3015 | 16 | 700652256H1 | SOYMON003 | g170772 | BLASTN | 591 | 1e-90 | 88 |
| 3016 | 16 | LIB3065-011-Q1-N1-A4 | LIB3065 | g170772 | BLASTN | 1182 | 1e-89 | 78 |
| 3017 | 16 | 700653827H1 | SOYMON003 | g170772 | BLASTN | 660 | 1e-87 | 81 |
| 3018 | 16 | 701099940H1 | SOYMON028 | g1220121 | BLASTN | 1154 | 1e-87 | 88 |
| 3019 | 16 | 701003671H1 | SOYMON019 | g170772 | BLASTN | 1131 | 1e-85 | 92 |
| 3020 | 16 | 700752105H1 | SOYMON014 | g170772 | BLASTN | 1116 | 1e-84 | 91 |
| 3021 | 16 | 700653057H1 | SOYMON003 | g170772 | BLASTN | 990 | 1e-83 | 88 |
| 3022 | 16 | 700945531H1 | SOYMON024 | g535583 | BLASTN | 1109 | 1e-83 | 89 |
| 3023 | 16 | 700980013H1 | SOYMON009 | g535583 | BLASTN | 1109 | 1e-83 | 88 |
| 3024 | 16 | 701127812H1 | SOYMON037 | g170772 | BLASTN | 1110 | 1e-83 | 91 |
| 3025 | 16 | LIB3056-014-Q1-N1-F8 | LIB3056 | g170772 | BLASTN | 798 | 1e-81 | 82 |
| 3026 | 16 | 700653862H1 | SOYMON003 | g1220121 | BLASTN | 960 | 1e-80 | 88 |
| 3027 | 16 | 700994148H1 | SOYMON011 | g535583 | BLASTN | 1069 | 1e-80 | 86 |
| 3028 | 16 | 700984184H1 | SOYMON009 | g170772 | BLASTN | 756 | 1e-79 | 86 |
| 3029 | 16 | 701123715H1 | SOYMON037 | g1220121 | BLASTN | 1059 | 1e-79 | 87 |
| 3030 | 16 | 700839038H1 | SOYMON020 | g170772 | BLASTN | 1060 | 1e-79 | 93 |
| 3031 | 16 | 700978445H1 | SOYMON009 | g170772 | BLASTN | 1062 | 1e-79 | 89 |
| 3032 | 16 | 701123035H1 | SOYMON037 | g170772 | BLASTN | 829 | 1e-78 | 90 |
| 3033 | 16 | 701041545H1 | SOYMON029 | g170772 | BLASTN | 1030 | 1e-77 | 86 |
| 3034 | 16 | 700898192H1 | SOYMON027 | g1220121 | BLASTN | 1031 | 1e-77 | 89 |
| 3035 | 16 | 700985750H1 | SOYMON009 | g169662 | BLASTN | 1033 | 1e-77 | 85 |
| 3036 | 16 | 700730995H1 | SOYMON009 | g170772 | BLASTN | 1040 | 1e-77 | 91 |
| 3037 | 16 | 700555909H1 | SOYMON001 | g535583 | BLASTN | 593 | 1e-76 | 84 |
| 3038 | 16 | 700746538H1 | SOYMON013 | g535583 | BLASTN | 834 | 1e-76 | 88 |
| 3039 | 16 | 700941380H1 | SOYMON024 | g170772 | BLASTN | 991 | 1e-76 | 91 |
| 3040 | 16 | 701118851H1 | SOYMON037 | g170772 | BLASTN | 1019 | 1e-76 | 89 |
| 3041 | 16 | 701065379H1 | SOYMON034 | g535583 | BLASTN | 1022 | 1e-76 | 86 |
| 3042 | 16 | 701209645H1 | SOYMON035 | g170772 | BLASTN | 795 | 1e-75 | 86 |
| 3043 | 16 | 701055017H1 | SOYMON032 | g1220121 | BLASTN | 877 | 1e-75 | 86 |
| 3044 | 16 | 701015213H1 | SOYMON019 | g535583 | BLASTN | 1008 | 1e-75 | 87 |
| 3045 | 16 | 700982770H1 | SOYMON009 | g1220121 | BLASTN | 1009 | 1e-75 | 85 |
| 3046 | 16 | 701212420H1 | SOYMON035 | g535583 | BLASTN | 1012 | 1e-75 | 86 |
| 3047 | 16 | 700977916H1 | SOYMON009 | g170772 | BLASTN | 700 | 1e-74 | 89 |
| 3048 | 16 | 700974401H1 | SOYMON005 | g1220121 | BLASTN | 857 | 1e-74 | 89 |
| 3049 | 16 | 700645749H1 | SOYMON010 | g170772 | BLASTN | 996 | 1e-74 | 82 |
| 3050 | 16 | 700646620H1 | SOYMON014 | g170772 | BLASTN | 996 | 1e-74 | 89 |
| 3051 | 16 | 701126103H1 | SOYMON037 | g170772 | BLASTN | 1000 | 1e-74 | 88 |
| 3052 | 16 | 700978001H1 | SOYMON009 | g170772 | BLASTN | 563 | 1e-73 | 89 |
| 3053 | 16 | 700561987H1 | SOYMON002 | g1220121 | BLASTN | 782 | 1e-73 | 87 |
| 3054 | 16 | 701101526H1 | SOYMON028 | g1220121 | BLASTN | 810 | 1e-73 | 88 |
| 3055 | 16 | 700562680H1 | SOYMON002 | g170772 | BLASTN | 985 | 1e-73 | 87 |
| 3056 | 16 | 700560521H1 | SOYMON001 | g170772 | BLASTN | 988 | 1e-73 | 80 |
| 3057 | 16 | 701055544H1 | SOYMON032 | g170772 | BLASTN | 992 | 1e-73 | 88 |
| 3058 | 16 | 701061418H1 | SOYMON033 | g170772 | BLASTN | 993 | 1e-73 | 87 |
| 3059 | 16 | 701049514H1 | SOYMON032 | g1220121 | BLASTN | 884 | 1e-72 | 88 |
| 3060 | 16 | 700646215H1 | SOYMON012 | g170772 | BLASTN | 971 | 1e-72 | 89 |
| 3061 | 16 | 701014875H1 | SOYMON019 | g535583 | BLASTN | 973 | 1e-72 | 87 |
| 3062 | 16 | 700874718H1 | SOYMON018 | g169662 | BLASTN | 974 | 1e-72 | 86 |
| 3063 | 16 | 700897796H1 | SOYMON027 | g1220121 | BLASTN | 977 | 1e-72 | 87 |
| 3064 | 16 | 700548019H1 | SOYMON001 | g170772 | BLASTN | 547 | 1e-71 | 87 |
| 3065 | 16 | 700904875H1 | SOYMON022 | g535583 | BLASTN | 963 | 1e-71 | 88 |
| 3066 | 16 | 701106315H1 | SOYMON036 | g170772 | BLASTN | 557 | 1e-70 | 90 |
| 3067 | 16 | 700745023H1 | SOYMON013 | g407411 | BLASTN | 949 | 1e-70 | 85 |
| 3068 | 16 | 701120348H1 | SOYMON037 | g170772 | BLASTN | 956 | 1e-70 | 86 |
| 3069 | 16 | 701124508H1 | SOYMON037 | g170772 | BLASTN | 578 | 1e-69 | 84 |
| 3070 | 16 | 700956183H1 | SOYMON022 | g1220121 | BLASTN | 625 | 1e-69 | 87 |
| 3071 | 16 | 700894619H1 | SOYMON024 | g535583 | BLASTN | 828 | 1e-69 | 85 |
| 3072 | 16 | 700923392H1 | SOYMON024 | g535583 | BLASTN | 936 | 1e-69 | 85 |
| 3073 | 16 | 700730676H1 | SOYMON009 | g535583 | BLASTN | 939 | 1e-69 | 86 |
| 3074 | 16 | 700728913H1 | SOYMON009 | g407411 | BLASTN | 940 | 1e-69 | 87 |
| 3075 | 16 | 700845737H1 | SOYMON021 | g1220121 | BLASTN | 528 | 1e-68 | 88 |
| 3076 | 16 | 700990961H1 | SOYMON011 | g170772 | BLASTN | 582 | 1e-68 | 85 |
| 3077 | 16 | 700983443H1 | SOYMON009 | g170772 | BLASTN | 922 | 1e-68 | 86 |
| 3078 | 16 | 701120754H1 | SOYMON037 | g170772 | BLASTN | 923 | 1e-68 | 88 |
| 3079 | 16 | 700900486H1 | SOYMON027 | g1220121 | BLASTN | 924 | 1e-68 | 83 |
| 3080 | 16 | 701133574H2 | SOYMON038 | g170772 | BLASTN | 929 | 1e-68 | 88 |
| 3081 | 16 | 700900924H1 | SOYMON027 | g170772 | BLASTN | 931 | 1e-68 | 88 |
| 3082 | 16 | 701056706H1 | SOYMON032 | g170772 | BLASTN | 486 | 1e-67 | 89 |
| 3083 | 16 | 701110051H1 | SOYMON036 | g170772 | BLASTN | 910 | 1e-67 | 88 |
| 3084 | 16 | 701136325H1 | SOYMON038 | g170772 | BLASTN | 915 | 1e-67 | 87 |
| 3085 | 16 | 700750809H1 | SOYMON014 | g170772 | BLASTN | 900 | 1e-66 | 88 |
| 3086 | 16 | 700686607H1 | SOYMON008 | g170772 | BLASTN | 901 | 1e-66 | 88 |
| 3087 | 16 | 700848261H1 | SOYMON021 | g535583 | BLASTN | 905 | 1e-66 | 87 |

-continued

ADENOSYLHOMOCYSTEINASE (EC 3.3.1.1)

| Seq No. | Cluster ID | CloneID | Library | NCBI gi | Method | Score | P-value | % Ident |
|---|---|---|---|---|---|---|---|---|
| 3088 | 16 | 700686634H1 | SOYMON008 | g170772 | BLASTN | 905 | 1e−66 | 88 |
| 3089 | 16 | 700891285H1 | SOYMON024 | g170772 | BLASTN | 906 | 1e−66 | 88 |
| 3090 | 16 | 700560291H1 | SOYMON001 | g170772 | BLASTN | 906 | 1e−66 | 88 |
| 3091 | 16 | 700752975H1 | SOYMON014 | g170772 | BLASTN | 907 | 1e−66 | 89 |
| 3092 | 16 | 701006013H2 | SOYMON019 | g170772 | BLASTN | 908 | 1e−66 | 87 |
| 3093 | 16 | 700974038H1 | SOYMON005 | g1220121 | BLASTN | 631 | 1e−65 | 88 |
| 3094 | 16 | 701047024H1 | SOYMON032 | g170772 | BLASTN | 707 | 1e−65 | 89 |
| 3095 | 16 | 700900409H1 | SOYMON027 | g170772 | BLASTN | 737 | 1e−65 | 83 |
| 3096 | 16 | 701137320H1 | SOYMON038 | g170772 | BLASTN | 769 | 1e−65 | 88 |
| 3097 | 16 | 700978805H1 | SOYMON009 | g170772 | BLASTN | 886 | 1e−65 | 84 |
| 3098 | 16 | 700726195H1 | SOYMON009 | g1220121 | BLASTN | 889 | 1e−65 | 87 |
| 3099 | 16 | 700661112H1 | SOYMON005 | g170772 | BLASTN | 661 | 1e−64 | 85 |
| 3100 | 16 | 700989712H1 | SOYMON011 | g170772 | BLASTN | 788 | 1e−64 | 88 |
| 3101 | 16 | 700752287H1 | SOYMON014 | g170772 | BLASTN | 875 | 1e−64 | 85 |
| 3102 | 16 | 700964226H1 | SOYMON022 | g170772 | BLASTN | 877 | 1e−64 | 88 |
| 3103 | 16 | 700847346H1 | SOYMON021 | g170772 | BLASTN | 880 | 1e−64 | 83 |
| 3104 | 16 | 700756428H1 | SOYMON014 | g170772 | BLASTN | 883 | 1e−64 | 88 |
| 3105 | 16 | 701049928H1 | SOYMON032 | g170772 | BLASTN | 885 | 1e−64 | 82 |
| 3106 | 16 | 700848652H1 | SOYMON021 | g170772 | BLASTN | 477 | 1e−63 | 89 |
| 3107 | 16 | 700898929H1 | SOYMON027 | g1220121 | BLASTN | 514 | 1e−63 | 87 |
| 3108 | 16 | 700903523H1 | SOYMON022 | g170772 | BLASTN | 527 | 1e−63 | 82 |
| 3109 | 16 | 700983745H1 | SOYMON009 | g1220121 | BLASTN | 863 | 1e−63 | 88 |
| 3110 | 16 | 700890587H1 | SOYMON024 | g170772 | BLASTN | 865 | 1e−63 | 86 |
| 3111 | 16 | 700969917H1 | SOYMON005 | g407411 | BLASTN | 868 | 1e−63 | 83 |
| 3112 | 16 | 700808487H1 | SOYMON024 | g170772 | BLASTN | 870 | 1e−63 | 88 |
| 3113 | 16 | 700749968H1 | SOYMON013 | g170772 | BLASTN | 871 | 1e−63 | 87 |
| 3114 | 16 | 700751254H1 | SOYMON014 | g170772 | BLASTN | 575 | 1e−62 | 87 |
| 3115 | 16 | 701014277H1 | SOYMON019 | g170772 | BLASTN | 739 | 1e−62 | 86 |
| 3116 | 16 | 700853635H1 | SOYMON023 | g170772 | BLASTN | 854 | 1e−62 | 87 |
| 3117 | 16 | 700752357H1 | SOYMON014 | g170772 | BLASTN | 856 | 1e−62 | 88 |
| 3118 | 16 | 700754523H1 | SOYMON014 | g170772 | BLASTN | 856 | 1e−62 | 92 |
| 3119 | 16 | 700982153H1 | SOYMON009 | g170772 | BLASTN | 400 | 1e−61 | 82 |
| 3120 | 16 | 700958283H1 | SOYMON022 | g170772 | BLASTN | 839 | 1e−61 | 87 |
| 3121 | 16 | 700980911H1 | SOYMON009 | g170772 | BLASTN | 842 | 1e−61 | 82 |
| 3122 | 16 | 700788112H1 | SOYMON011 | g170772 | BLASTN | 844 | 1e−61 | 83 |
| 3123 | 16 | 701005927H1 | SOYMON019 | g170772 | BLASTN | 849 | 1e−61 | 88 |
| 3124 | 16 | 700756443H1 | SOYMON014 | g170772 | BLASTN | 849 | 1e−61 | 88 |
| 3125 | 16 | 700658914H1 | SOYMON004 | g1220121 | BLASTN | 468 | 1e−60 | 85 |
| 3126 | 16 | 701135266H1 | SOYMON038 | g170772 | BLASTN | 827 | 1e−60 | 87 |
| 3127 | 16 | 700982179H1 | SOYMON009 | g170772 | BLASTN | 827 | 1e−60 | 82 |
| 3128 | 16 | 700754593H1 | SOYMON014 | g170772 | BLASTN | 832 | 1e−60 | 81 |
| 3129 | 16 | 700831723H1 | SOYMON019 | g170772 | BLASTN | 814 | 1e−59 | 91 |
| 3130 | 16 | 700986775H1 | SOYMON009 | g170772 | BLASTN | 815 | 1e−59 | 92 |
| 3131 | 16 | 700755219H1 | SOYMON014 | g170772 | BLASTN | 820 | 1e−59 | 84 |
| 3132 | 16 | 701015494H1 | SOYMON019 | g170772 | BLASTN | 822 | 1e−59 | 88 |
| 3133 | 16 | 701008473H1 | SOYMON019 | g170772 | BLASTN | 823 | 1e−59 | 87 |
| 3134 | 16 | 700754981H1 | SOYMON014 | g170772 | BLASTN | 824 | 1e−59 | 88 |
| 3135 | 16 | 700870790H1 | SOYMON018 | g170772 | BLASTN | 825 | 1e−59 | 81 |
| 3136 | 16 | 700833069H1 | SOYMON019 | g170772 | BLASTN | 806 | 1e−58 | 86 |
| 3137 | 16 | 700680127H2 | SOYMON008 | g535583 | BLASTN | 807 | 1e−58 | 86 |
| 3138 | 16 | 701015374H1 | SOYMON019 | g170772 | BLASTN | 807 | 1e−58 | 87 |
| 3139 | 16 | 700872895H1 | SOYMON018 | g535583 | BLASTN | 808 | 1e−58 | 88 |
| 3140 | 16 | 701137912H1 | SOYMON038 | g170772 | BLASTN | 374 | 1e−57 | 83 |
| 3141 | 16 | 700984063H1 | SOYMON009 | g1220121 | BLASTN | 575 | 1e−57 | 79 |
| 3142 | 16 | 700991988H1 | SOYMON011 | g170772 | BLASTN | 791 | 1e−57 | 82 |
| 3143 | 16 | 700873915H1 | SOYMON018 | g170772 | BLASTN | 793 | 1e−57 | 88 |
| 3144 | 16 | 700978721H1 | SOYMON009 | g170772 | BLASTN | 797 | 1e−57 | 78 |
| 3145 | 16 | 701213679H1 | SOYMON035 | g170772 | BLASTN | 798 | 1e−57 | 88 |
| 3146 | 16 | 701102954H1 | SOYMON028 | g170772 | BLASTN | 799 | 1e−57 | 79 |
| 3147 | 16 | 700888289H1 | SOYMON024 | g170772 | BLASTN | 712 | 1e−56 | 91 |
| 3148 | 16 | 700962086H1 | SOYMON022 | g170772 | BLASTN | 783 | 1e−56 | 88 |
| 3149 | 16 | 701052227H1 | SOYMON032 | g535583 | BLASTN | 788 | 1e−56 | 86 |
| 3150 | 16 | 700755177H1 | SOYMON014 | g170772 | BLASTN | 768 | 1e−55 | 88 |
| 3151 | 16 | 701123136H1 | SOYMON037 | g170772 | BLASTN | 771 | 1e−55 | 82 |
| 3152 | 16 | 700979067H1 | SOYMON009 | g170772 | BLASTN | 776 | 1e−55 | 90 |
| 3153 | 16 | 700755513H1 | SOYMON014 | g170772 | BLASTN | 759 | 1e−54 | 92 |
| 3154 | 16 | 700756639H1 | SOYMON014 | g170772 | BLASTN | 761 | 1e−54 | 81 |
| 3155 | 16 | 700554077H1 | SOYMON001 | g170772 | BLASTN | 371 | 1e−53 | 86 |
| 3156 | 16 | 700653194H1 | SOYMON003 | g170772 | BLASTN | 395 | 1e−53 | 86 |
| 3157 | 16 | 701110348H1 | SOYMON036 | g170772 | BLASTN | 743 | 1e−53 | 81 |
| 3158 | 16 | 700753973H1 | SOYMON014 | g170772 | BLASTN | 743 | 1e−53 | 87 |
| 3159 | 16 | 701011009H1 | SOYMON019 | g535583 | BLASTN | 733 | 1e−52 | 81 |
| 3160 | 16 | 700739086H1 | SOYMON012 | g170772 | BLASTN | 456 | 1e−51 | 87 |
| 3161 | 16 | 700740140H1 | SOYMON012 | g170772 | BLASTN | 723 | 1e−51 | 89 |

-continued

ADENOSYLHOMOCYSTEINASE (EC 3.3.1.1)

| Seq No. | Cluster ID | CloneID | Library | NCBI gi | Method | Score | P-value | % Ident |
|---|---|---|---|---|---|---|---|---|
| 3162 | 16 | 700565040H1 | SOYMON002 | g170772 | BLASTN | 729 | 1e−51 | 74 |
| 3163 | 16 | 701148186H1 | SOYMON031 | g535583 | BLASTN | 665 | 1e−50 | 85 |
| 3164 | 16 | 701142734H1 | SOYMON038 | g535583 | BLASTN | 670 | 1e−47 | 86 |
| 3165 | 16 | 700754441H1 | SOYMON014 | g170772 | BLASTN | 385 | 1e−46 | 93 |
| 3166 | 16 | 701102588H1 | SOYMON028 | g1220121 | BLASTN | 662 | 1e−46 | 89 |
| 3167 | 16 | 700900656H1 | SOYMON027 | g535583 | BLASTN | 635 | 1e−44 | 87 |
| 3168 | 16 | 700974207H1 | SOYMON005 | g535583 | BLASTN | 641 | 1e−44 | 85 |
| 3169 | 16 | 700982081H1 | SOYMON009 | g170772 | BLASTN | 494 | 1e−43 | 78 |
| 3170 | 16 | 701130026H1 | SOYMON037 | g1220121 | BLASTN | 482 | 1e−42 | 86 |
| 3171 | 16 | 701009720H1 | SOYMON019 | g170772 | BLASTN | 621 | 1e−42 | 87 |
| 3172 | 16 | 700962602H1 | SOYMON022 | g170772 | BLASTN | 357 | 1e−40 | 91 |
| 3173 | 16 | 700724934H1 | SOYMON009 | g535583 | BLASTN | 561 | 1e−40 | 81 |
| 3174 | 16 | 700729305H1 | SOYMON009 | g535583 | BLASTN | 544 | 1e−39 | 82 |
| 3175 | 16 | 701210054H1 | SOYMON035 | g535583 | BLASTN | 569 | 1e−38 | 85 |
| 3176 | 16 | 700790192H1 | SOYMON011 | g535583 | BLASTN | 293 | 1e−37 | 83 |
| 3177 | 16 | 700984076H1 | SOYMON009 | g170772 | BLASTN | 198 | 1e−35 | 88 |
| 3178 | 16 | 700726562H1 | SOYMON009 | g170772 | BLASTN | 307 | 1e−34 | 78 |
| 3179 | 16 | 701211376H1 | SOYMON035 | g170772 | BLASTN | 524 | 1e−34 | 86 |
| 3180 | 16 | 700753085H1 | SOYMON014 | g2588780 | BLASTN | 358 | 1e−33 | 76 |
| 3181 | 16 | 700727993H1 | SOYMON009 | g535583 | BLASTN | 465 | 1e−32 | 84 |
| 3182 | 16 | 700561072H1 | SOYMON001 | g170772 | BLASTN | 473 | 1e−30 | 83 |
| 3183 | 16 | 701211464H1 | SOYMON035 | g170772 | BLASTN | 464 | 1e−28 | 81 |
| 3184 | 16 | 701098045H1 | SOYMON028 | g169660 | BLASTN | 386 | 1e−21 | 78 |
| 3185 | 16 | 700945233H1 | SOYMON024 | g407412 | BLASTX | 150 | 1e−18 | 87 |
| 3186 | 16 | 700752655H1 | SOYMON014 | g758247 | BLASTX | 172 | 1e−16 | 94 |
| 3187 | 16 | 700735356H1 | SOYMON010 | g758247 | BLASTX | 152 | 1e−14 | 100 |
| 3188 | 16 | 700683995H1 | SOYMON008 | g758247 | BLASTX | 106 | 1e−13 | 90 |
| 3189 | 16 | 700658760H1 | SOYMON004 | g1857024 | BLASTX | 123 | 1e−13 | 63 |
| 3190 | 16 | 700762885H1 | SOYMON015 | g1857024 | BLASTX | 134 | 1e−13 | 89 |
| 3191 | 16 | 700755740H1 | SOYMON014 | g170773 | BLASTX | 149 | 1e−13 | 100 |
| 3192 | 16 | 700854969H1 | SOYMON023 | g170772 | BLASTX | 178 | 1e−12 | 80 |
| 3193 | 16 | 701143036H1 | SOYMON038 | g169661 | BLASTX | 113 | 1e−8 | 83 |
| 3194 | 18409 | 700786561H1 | SOYMON011 | g535583 | BLASTN | 992 | 1e−73 | 85 |
| 3195 | 18409 | 701008057H1 | SOYMON019 | g535583 | BLASTN | 831 | 1e−60 | 87 |
| 3196 | 18409 | 701037442H1 | SOYMON029 | g535583 | BLASTN | 669 | 1e−46 | 86 |
| 3197 | 18409 | 700942865H1 | SOYMON024 | g535583 | BLASTN | 464 | 1e−32 | 86 |
| 3198 | 7322 | 700651524H1 | SOYMON003 | g170772 | BLASTN | 466 | 1e−65 | 80 |
| 3199 | 7322 | 700565758H1 | SOYMON002 | g170772 | BLASTN | 450 | 1e−63 | 81 |

CYSTATHIONINE β-SYNTHASE (EC 4.2.1.22)

| Seq No. | Cluster ID | CloneID | Library | NCBI gi | Method | Score | P-value | % Ident |
|---|---|---|---|---|---|---|---|---|
| 1631 | −700025795 | 700025795H1 | SATMON003 | g1323263 | BLASTX | 186 | 1e−25 | 68 |
| 1632 | 20651 | 700344783H1 | SATMON021 | g1813975 | BLASTX | 41 | 1e−9 | 53 |

CYSTATHIONINE γ-LYASE (EC 4.4.1.1)

| Seq No. | Cluster ID | CloneID | Library | NCBI gi | Method | Score | P-value | % Ident |
|---|---|---|---|---|---|---|---|---|
| 1633 | −700260027 | 700260027H1 | SATMON017 | g169475 | BLASTX | 112 | 1e−10 | 75 |
| 1634 | 1228 | 700027629H1 | SATMON003 | g169475 | BLASTX | 189 | 1e−19 | 87 |
| 3203 | −700750583 | 700750583H1 | SOYMON014 | g169475 | BLASTX | 149 | 1e−13 | 78 |
| 3204 | 12502 | LIB3051-069-Q1-K1-E6 | LIB3051 | g2641242 | BLASTX | 86 | 1e−30 | 38 |

| O-ACETYLHOMOSERINE (THIOL)-LYASE (EC 4.2.99.10) | | | | | | | | |
|---|---|---|---|---|---|---|---|---|
| Seq No. | Cluster ID | CloneID | Library | NCBI gi | Method | Score | P-value | % Ident |
| 3200 | 12502 | 701135185H1 | SOYMON038 | g1628606 | BLASTX | 100 | 1e−10 | 48 |
| 3201 | 12502 | 701042913H1 | SOYMON029 | g2605905 | BLASTX | 110 | 1e−9 | 42 |
| 3202 | 12502 | 701059330H1 | SOYMON033 | g2605905 | BLASTX | 110 | 1e−9 | 42 |

*Table Headings

Cluster ID

A cluster ID is arbitrarily assigned to all of those clones which belong to the same cluster at a given stringency and a particular clone will belong to only one cluster at a given stringency. If a cluster contains only a single clone (a "singleton"), then the cluster ID number will be negative, with an absolute value equal to the clone ID number of its single member. The cluster ID entries in the table refer to the cluster with which the particular clone in each row is associated.

Clone ID

The clone ID number refers to the particular clone in the PhytoSeq database. Each clone ID entry in the table refers to the clone whose sequence is used for (1) the sequence comparison whose scores are presented and/or (2) assignment to the particular cluster which is presented. Note that a clone may be included in this table even if its sequence comparison scores fail to meet the minimum standards for similarity. In such a case, the clone is included due solely to its association with a particular cluster for which sequences of one or more other member clones possess the required level of similarity.

Library

The library ID refers to the particular cDNA library from which a given clone is obtained. Each cDNA library is associated with the particular tissue(s), line(s) and developmental stage(s) from which it is isolated.

NCBI gi

Each sequence in the GENBANK public database is arbitrarily assigned a unique NCBI gi (National Center for Biotechnology Information GenBank Identifier) number. In this table, the NCBI gi number which is associated (in the same row) with a given clone refers to the particular GenBank sequence which is used in the sequence comparison. This entry is omitted when a clone is included solely due to its association with a particular cluster.

Method

The entry in the "Method" column of the table refers to the type of BLAST search that is used for the sequence comparison. "CLUSTER" is entered when the sequence comparison scores for a given clone fail to meet the minimum values required for significant similarity. In such cases, the clone is listed in the table solely as a result of its association with a given cluster for which sequences of one or more other member clones possess the required level of similarity.

Score

Each entry in the "Score" column of the table refers to the BLAST score that is generated by sequence comparison of the designated clone with the designated GENBANK sequence using the designated BLAST method. This entry is omitted when a clone is included solely due to its association with a particular cluster. If the program used to determine the hit is HMMSW then the score refers to HMMSW score.

P-Value

The entries in the P-Value column refer to the probability that such matches occur by chance.

%Ident

The entries in the "%Ident" column of the table refer to the percentage of identically matched nucleotides (or residues) that exist along the length of that portion of the sequences which is aligned by the BLAST comparison to generate the statistical scores presented. This entry is omitted when a clone is included solely due to its association with a particular cluster.

SEQUENCE LISTING (3204 sequences)

SEQ ID NO: 1 - DNA, 235 bp, Zea mays
  unsure (1)..(235): unsure at all n locations
gttttccgtctagcctcggtggacagatcgacgctgcccatgctgataaatggacggtcctgatccattgttcgttgtgttattaatgttgtataattgagcaggacacaacacgtacgttnnnnnnnnnnnnnnnnnnnnnnnnnnnnnnnnnnnnncaggttcatcaagaccgccgcatacggccactttggccgtgacgacgccgacttcacctgcgaggtggtcaagcccc

SEQ ID NO: 2 - DNA, 313 bp, Zea mays
  unsure (1)..(313): unsure at all n locations
cacatccgtttgnctcttctcnntcttgccggtcccgaataaaaancagcancgcaagangtcggtagancnagaagaangcantngcggccganangttccttttcacntcggagtccgtgnannaggcgcancccgacaagctgtgcgaccaggtgtcggacgccgtgnttgacgcntgcctcncncagnaccccgacancaangtngcctgncacangtgcaccaagaccaacntggtgatggtgttcggcgagntnacgaccaaggcgaccgttgactannagaagatcgtnggnnacacntgccgcga

SEQ ID NO: 3 - DNA, 77 bp, Zea mays
  unsure (1)..(77): unsure at all n locations
ctgcgagaccttcacnaagaccaacatggtgatgttgntcggcgnnatcacgaccnangctacngtggnctacnaga

SEQ ID NO: 4 - DNA, 279 bp, Zea mays
  unsure (1)..(279): unsure at all n locations
tcatcattgacacctacngtggctggggagcccatggtggtggcgctttctccggcaagnnnncnannanngnnnantgcagnngncgntatntannaaggcacnatncnttgatgtctgcgatgacacggactattcttggagagcaaagggcttccatgagcaagcaaaagctgccggtgttccggctattactactgctggcatctatccaggagttagcaatgtgatggctgctgacttgtacatgtgccagaagtgaaaatgngaacctgaaga

SEQ ID NO: 5 - DNA, 211 bp, Zea mays
  unsure (1)..(211): unsure at all n locations
ggaccgcagcggcgcntangtggccaggcaggccgccaagagnatcntggncagnggatcgcncgcngctgcctcgtgcaggtgtacgtacnccatnggntggccggannccctgnccgtgttcgtnaactcgtacgagcaccggcacgntnaangncaaggagatcntcaanatcntnanaggagaacttcgacttcaggcccgggatga

SEQ ID NO: 6 - DNA, 266 bp, Zea mays
gtctgttttttttccccattaattgtcaatctacaattcaaatcacattcacaatgggtagcgtcagccacaagacaggaactttcctgttcacctccgagtccgtaggtgaaggtcaccctgacaagatcgctgatcaggtctctgacgccgttctcgatgcctgcttggccgaggaccctctctccaaagtcgcttgcgagactgctaccaagaccggtatgatcatggtcttcggtgaaatcaccaccaaagccaagctcgat

SEQ ID NO: 7 - DNA, 168 bp, Zea mays
  unsure (1)..(168): unsure at all n locations
gggggcgtttccnccagttctgtgggngctaccgtgtagnntcgtcggccgatncacgcntctaangntgagtcggtcnacaacgacganatcgccgnngacctcanggagcacgtcnncanncncgtgatgnctgataagtacctcgacgagaagaccatcttncac

SEQ ID NO: 8 - DNA, 570 bp, Zea mays
  unsure (1)..(570): unsure at all n locations
ggnnnnnnnnaacttctagntgnncggtgccgtcanaaattcaagggtcnacccacgcgccgaacacgcntccgcccacgcgtccgcccacgcgtccggactagttctagatggcggtgcgctttctccggcaaggacccaaccaaggttgaccgcagcggagcctatgtcgcgaggaggctgccaagagcatcgtcgccagcggccttgctcgccgcgccatcgtccaggtgtccacgccatcggcgtgcccgagcctctctccgttgttttgtcgacaacttacggcaaccggcgccattccccgacaagggagattcctcaaagattgtcaaagggagaaatttcgaatttaagggccttggcaatgattaatcaatcaaacctttgaacctccaaagaaaaanggcgggaaacnggcggctaacctcnaanaacgggcaagcctaatggggcaacttcggaaaggggaaaccctggactttcacctgggaaaggtgggtgaaaacccactcaaantcggggggaaaactttcggcctnaaaggggggccttttttttnaataaana

SEQ ID NO: 9 - DNA, 473 bp, Zea mays
  unsure (1)..(473): unsure at all n locations
tcttnagtgtncncngncgcctgccntcgttttgggccccggccccctataatgagtcaantanngcgtccgaatttttttcncgtngaananttgntcnngggcggcgccatggtgccgtccgcgtgcanaccgtgctcatctccacccagcacancgannccgtgggaacgncgantcnccgcngnnntcnaggggnacgtcatcaagcccgtgatccctgngacgtncctcgngagaagaccntcttccacctcnncccgtccgggcgcttcntcancggcnggccccncgggacgccggcctcaccngccgcnngatcatcntcgggcncatncggcngctggggagccccttttttggcgccttctccnggnnnggnccctagcancggtngaccgcancggcgcctantgnccctnncaggccnccancanncatcttggccagcggcctcngcccggncgncncct

SEQ ID NO: 10 - DNA, 428 bp, Zea mays
  unsure (1)..(428): unsure at all n locations
acctaaaggnttacgttatcaagccngtcatcccaganaggggcgggggactagaagacgntgntncacctcaacccgtcngggcgcttnntcatcngcgggccccacggtgactcctnnctcaccggccancaagatcatcatngacacctacggcnnctggggagcccacnncgngggcgccttcttcggnaaggaccccaccaaggtgnaccnnaanggggcctacntcgccnnncatgncgtcaagagcattgtggccagncgcctnttncnacgcttgctcgtgcaggtgtactacgncatcggcgtgcctgaancnctttcantnttcgttgaattctanagnaaccgggaccattcccgacaagganaatcttaaagatngttaangatnaactttncttcaaggnccnggntgatcacca

SEQ ID NO: 11 - DNA, 87 bp, Zea mays
  unsure (1)..(87): unsure at all n locations
tggtctngnctgtctgcnctctatcatgcnttnttatggctcctacnagttgtnattcttgatntgnccctngcttatcattttact

SEQ ID NO: 12 - DNA, 444 bp, Zea mays
  unsure (1)..(444): unsure at all n locations
tnatgttgttcggcgagatcaccaccaangcgagngtntactacgagaagatngtgcgcgacacctgccgcgagatctggttcacctccnacnacntgggggctcgaccccaccnctcaaggtgcttgttaacatttacancaatcccccacattcccaaggcnttcacnggcactttaacaaaacgnccnaaggaaaatcggccccgcnaacaaagccaaatttttcggttccccacccancanacncccaacttattccccttaaccacctgcttgcaccaaactttttnncnccccttantcgaagttcnnaaaggacngnacctttcctttgttaaaccccaaagnaaaaaccaaatttaccgttnnantntnttaaaaaaaggccgcnccctnttnncccttttccnttcacaaccctnttttattttttanncaaaaa

SEQ ID NO: 13 - DNA, 513 bp, Zea mays
  unsure (1)..(513): unsure at all n locations
gnngnnnngnggtaattcnacgccgganggtaccggtcagcnaattcccgggtcnacccacgcgtccgaagggtgtgcatggccacttcaccaagcgccccgaggagattggagctggtgaccagggacacatgttcgggtatgcgaccgatgagacccctgagttgatgcccctcagccatgtccttgccaccaagctaggtgctcgtctcaccgaggtccgcaagaacggaacctgcccctggctcaggcctgatgggaagacccaggtgacagtcgagtaccgcaatgagggtggtgccatggtccccatccgtgtccacaccgtcctcatctccacccagcacgacgagacagtgaccaatgatgagatcgctgctgacctgaaggagcatgtcatcaagcctgtcatccctgagcagtaccttgacgagaagaccatcttccaccttaacccatctggccgctttgtcattggtggacctcaangcgaatctgggctcaatgggcnca

SEQ ID NO: 14 - DNA, 520 bp, Zea mays
  unsure (1)..(520): unsure at all n locations
gnnnggnggtnntnntgnagggggntgnanggaaanttgtaccggtncggaattcccgggtcgacccacgcgtccgtgatccctgagaagtacctcgacgagaagaccatcttccacctcaacccgtccgggcgcttcgtcatcggcgggccccacggtgacgccggcctcaccggccgcaagatcatcatcgacacgtacggcggctggggagcccacggcggtggcgccttctccggcaaggaccccaccaaggtggaccgcagcggcgcctacgtggccaggcaggccgccaagagcatcgtggccagcggcctcgcccgccgctgcctcgtgcaggtgtcgtacgccatcggcgtgccggagcccctgtccgtgttcgtcaactcgtacggcaccggcacgatccccgacaaggagatcctcaagatcgtgaaggagaacttcgacttcagcccgggatgatcaagcatcaacctngacctgaaagaaaggcngnaacanggtcattaaaaaccgc

SEQ ID NO: 15 - DNA, 511 bp, Zea mays
  unsure (1)..(511): unsure at all n locations
gtggggnttngnggnatttntaggccgnncgtaccggaccngaaattcccgggtccacccacgcgtccgcaagacccctgagctgatgcccctcagccatgtccttgccaccaagcttggtgctcgtctcacggaggttcgcaagaatggaacctgcccctggctcaggcccgatgggaagacccaggtgacagtggagtaccgcaacgagggtggcgccatggttcccatccgtgtgcacacagtcctcatctctacccagcacgacgagacagtcaccaacgacgagattgctgctgacctgaaggagcacgtcatcaagccagtcatccccgagcagtacctcgacgagaagacaatcttccacctcaacccgtctggccgcttcgtcatcggcggacctcacggcgacgctggcctcactggccggaagatcatcatcgacacctacggtggctggggaacccacggcgggggcgccttctccggcaaggacccgacaaggtggacc

SEQ ID NO: 16 - DNA, 483 bp, Zea mays
  unsure (1)..(483): unsure at all n locations
ttnaaactttcacgccgccaggtancggtcanagaattcccggggncgacccacgcgtcggccatggtccccatccgtgtccacaccgtcctcatctccacccagcacgacgagacaggaccaatgatgagatcgctgctgacctgaaggagcatgtcatcaagcctgtcatccctggcagtaccttgacgagaagaccatcttccaccttaacccatctggccgctttgtcattgtggacctcacggcgatgctggcctcactggccgcaagatcatcattgacacctacggtgctggggagcccatggtggtggcgctttctccggcaaggacccaaccaaggttgaccgcacggagcctatgtcgcaaggcaggctgccaagagcatcgtcgccagcggccttgctcgcccgccatcgtccaggtgtcttacgccatcggcgtgcccgaacctctctccgtgttcgtcgcacgtacggna

SEQ ID NO: 17 - DNA, 454 bp, Zea mays
  unsure (1)..(454): unsure at all n locations
ctcaccgaggtgcgcannaacggcacctgcgcctggctgaggcccgacggnnagacccaggtgacggtggagtacgtgaacgagggcggcgccatggtgcccgtccgcgtgcacaccgtgctcatctncacccagcacgacgagaccgtcaccaacgacgagatcgccgccgacctcaaggagcacgtcatcaagcccgtgatccctgagaagtacctngacgagaagaccatcttccacctnaacccgtccgggcgcttcgtcatcggcgggccccacggtgacgccggcctaccggcgcaagatcatcatcgacacgtacggcggctggggagcccacggcggtggcgccttcttcngcaaggaccccaccaangtggaccgcaacggngcctacgtgggcaggcangccgncaaaagcatngtggccaagcgggcttgcccgncgttgctt

SEQ ID NO: 18 - DNA, 474 bp, Zea mays
  unsure (1)..(474): unsure at all n locations
ccacgcgtccgcccacgcgtccggaccaaggcgaccgtggactacgagaagatcgtgcgcgacacctgccgggngatcgggttcacctgngncgacgtgggcctcgacgccnaccgctgcaaggtgctggtgaacatcgagcagcagtcccccgacatcgcgcanggcgtgcacgggcacttcacgaagcggcccgaggagatcggcgcgggcnaccagggccacatgttcgggtacgccaccgacnagacccccgagctgatgccgctcagccacgtgctggccaccaagctgggcgcgcgcctcaccgaggtgcncangaacggcacctgcncctggctgaggcccgacggcaagacccaggtgacngtggagtacgtgaacnagggcngctccatggtgcccgtccgngtgcacaccttgctnatcttcacccagnactacnagaccgtancaactactagatcgncttnt

SEQ ID NO: 19 - DNA, 435 bp, Zea mays
  unsure (1)..(435): unsure at all n locations
cgagggacaccctgacaagctctgtgaccaggtctgagatgccgttcttgacgcttgccttgctgaggaccctgacagcaaggttgcttgtgagacctgcaccaagaccaacatggtcatggtctttggtgagatcaccaccaaggccaatgttgactacgagaagattgtcagggagacctgccgcaacattggttttgtgtcaaacgatgttgggcttgacgccgaccactgcaaggtgctcgtgaacattgagcagcagtcccctgatattgctcanggtgtgcatggncacttaccaagcgccccgaggagattggagctggtgaccagggacacatgttcgggtatgcgaccgatgagacccctgagttgatgcccctcaccatgtccttggcaccaagctangtgctcgtcttaccgangtccgcaaag

SEQ ID NO: 20 - DNA, 422 bp, Zea mays
  unsure (1)..(422): unsure at all n locations
accgaggtgcgcaagaacggcacctgcgcctggctgaggcccgacggcaagacccaggtgacggtggagtacgtgaacgagggcggcgccatggtgcccgtccgcgtgcacaccgtgctcatctccacccagcacgacgagaccgtcaccaacgacgagatcgccgccgacctcaaggagcacgtcatcaagcccgtgatccctgagaagtacctcgacgagaagaccatcttccacctcaacccgtccgggcgcttcgtcatcggcgggccccacggtgacgccggcctcaccggccgcaagatcatcatcgacacgtacggcggctggggaacccaaggcggtggcgccttctccggcaaggacccaacaangtggaacgcaangggggccaanttggcaaggaagccgcaagaanatct

SEQ ID NO: 21 - DNA, 488 bp, Zea mays
  unsure (1)..(488): unsure at all n locations
ggnnnnngnaactttacgccggcnngtacgnctcanaaattccaaggncgacccacccgccncgaataaagagcagcagcgcaagaggtcggtagagcgagaagaaggcaatggcggcgagagcttccttttcacctcggagtccgtgaacgaggggcaccccgacaagctgtgcgacaggtgtcggacgccgtgcttgacgcatgcctcgcgcaggaccccgacagcaaggtggctgcgagacctgcaccaagaccaacatggtgatggtgttcggcgagatcacgaccaaggcaccgtggactacgagaagatcgtgcgcgacacctgccgcgagatcgggttcacctccgagacgtgggcctcgacgccgaccgctgcaaggtgctggtgaacatcgagcagcaatccccgacatcgcgcaaggcgtgcacgggcacttcacgaaacggnccgaggagatnggcgcngggacaagggccacatgt

SEQ ID NO: 22 - DNA, 491 bp, Zea mays
  unsure (1)..(491): unsure at all n locations
gggnnnnngnaanttttcttgcccgccaggtaccaatcaagaattcncgggtcgacccacgcntccngatcgctgctgacctgaaggagcatgtcatcaagcctgtcatccctgagcagtaccttgacgagaagaccatcttccaccttaacccatctggccgctttgtcattggtggacctcacggcgatgctggcctcactggccgcaagatcatcattgacacctacggtggctggggagcccatggtggtggcgctttctccggcaaggacccaaccaaggttgaccgcagcggagcctatgtcgcaaggcaggctgccaagagcatcgtcgccagcggccttgctcgccgcgccatcgtccaggtgtcttacgccatcggcgtgcccgagcctctctccgtgttcgtcgacacgtacggcaacggcgccattcccgacaaggagattctcaagaatgtcaagganaacttcaattcaaggctggga

SEQ ID NO: 23 - DNA, 439 bp, Zea mays
  unsure (1)..(439): unsure at all n locations
attggtggacctcacggcgatgctggcctcactggccgcaagatcatcattgncacntacggtggctggggagcccatggtggtggcgctttctccggcaaggacccaaccaaggttgaccgcagcggagcctatgtcgcaaggcaggctgccaagagcatcgtcgccagcggccttgctcgccgcgccatcgtccaggtgtcttacgccatcggcgtgcccgagcctctctccgtgttcgtcgacacgtacggcaccggcgcgatccccgacaaggagatcctcaagattgtcaaggagaacttcgatttcaggcctggcatgatcatcatcaaccttgacctcaagaaaggcggcaacgggcgctacctnaagacggnggnctacggcactttggaagggacgacctnacttncctnggangggggggaanccctta

SEQ ID NO: 24 - DNA, 502 bp, Zea mays
  unsure (1)..(502): unsure at all n locations
gggnnngnngnaactgtctaccttgcccgtgccggtccaaaattaacgggtccacccacgcgtccggnccaatgtcgactacgagaagattgtcagggagacatgccgcaacattggtttcgtgtcgaacgatgtcgggcttgacgctgaccactgcaaggtgcttgtgaacattgagcagcagtcccctgatattgctcagggtgtgcacggccacttcaccaagcgccccgaggagattggagctggtgaccaggggcacatgtttgggtatgcgactgacgagacccctgagctgatgcccctcagccatgtccttgccaccaagcttggtgctcgtctcacggaggttcgcaagaatggaacctgcccctggctcaggcccgatgggaagacccaggtgacagtggagtaccgcaacgagggtggcgccatggttcccatccgtgtgcacacagtcctcatctctacccaacacgacgaagacagtcaacaaacgacg

SEQ ID NO: 25 - DNA, 476 bp, Zea mays
  unsure (1)..(476): unsure at all n locations
ggnnnntnntnagnngggggattaatggnatgctntaccggtccggaattcccgggtcgacccacgcgtccgccgaggtccgcaagaacggaacctgcccctggctcaggcctgatgggaagacccaggtgacagtcgagtaccgcaatgagggtggtgccatggtccccatccgtgtccacaccgtcctcatctccacccagcacgacgagacagtgaccaatgatgagatcgctgctgacctgaaggagcatgtcatcaagcctgtcatccctgagcagtaccttgacgagaagaccatcttccaccttaacccatctggccgctttgtcattggtggacctcacggcgatgctggcctcactggccgcaagatcatcattgacacctacggtggctggggagcccatggtggtggcgctttctccggcaaggacccaaccaaggttgaccgcagcggacctatgtcgcaaggc

SEQ ID NO: 26 - DNA, 393 bp, Zea mays
cctgcaccaagaccaacatggtcatggtctttggtgagatcaccaccaaggccaatgttgactacgagaagattgtcagggagacctgccgcaacattggttttgtgtcaaacgatgttgggcttgacgccgaccactgcaaggtgctcgtgaacattgagcagcagtcccctgatattgctcagggtgtgcatggccacttcaccaagcgccccgaggagattggagctggtgaccagggacacatgttcgggtatgcgaccgatgagacccctgagttgatgcccctcagccatgtccttgccaccaagctaggtgctcgtctcaccgaggtccgcaagaacggaacctgcccctggctcaagcctgatgggaaaaaccaaggtgacagtc

SEQ ID NO: 27 - DNA, 435 bp, Zea mays
  unsure (1)..(435): unsure at all n locations
cgagacagtgaccaatgatgagatcgctgctgacctgaaggagcatgtcatcangcctgncatccctgagcagtaccttgacgagaagaccatcttccaccttaacccatctggccgctttgtcattggtggacctcacggcgatgctggcctcactggccgcaagatcatcattgacacctacngtggctggggagcccatggtggtggcgctttctccggcaaggacccaaccaaggttgaccgcagcggagcctatgtcgcaaggcaggctgccaagagcatcgtnnccagcggccttgctcgccgcgccatcgtccaggtgtcttacgccatcggngtgcccgagcctctctccgngttcgtngacacgtactgnaccggcctatccccnacaangagatcttaagattgtcaaggagaacttttatttca

SEQ ID NO: 28 - DNA, 435 bp, Zea mays
  unsure (1)..(435): unsure at all n locations
agcccacggcgggggcgccttctccggcaaggaccccaccaaggtggaccgcagcggggcctacgtcgccaggcaggccgccaagagcatcgtggccagcggcctcgcccgccgctgcctcgtgcaggtgtcctacgccatcggcgtgccggagcccctgtccgtgttcgtcgactcctacggcaccgggaccatccccgacaaggagatcctaaagatcgtcaaggagaacttcgacttcaggccagggatggtcaccatcaacctcgacctcaagaagggcggcaacaggttcatcaagaccgccgcatacggncactttggccgtgacgacgccgacttcacctgggaggtggtcaagcccctaaagaangcattccgcttaagaatgtattgggaagttcactggacatgaagttcatcttcgtctggctt

SEQ ID NO: 29 - DNA, 484 bp, Zea mays
  unsure (1)..(484): unsure at all n locations
ttcgnatggttcanactgccannacagntcaaggnctcgcgggtcganncangcctcnaggcanntncgcntgactgaggcccgacggcaagacccaggtgacggtggagtacgtgaacgagggcggcgccatggtgcccgtccgcgtgcacaccgtgctcatctccacccagcacgacgagaccgtcaccaacgacgagatcgccgccgacctcaaggagcacgtcatcaagcccgtgatccctgagaagtacctcgacgagaagaccatcttccacctcaacccgtccgggcgcttcgtcatcggcgggccccacggtgacgccggcctcaccggccgcaagatnatcatcgacacgtacggcggctggggagcccacggcggtggcgccttctccggcaaggaccccaccaaaggtggaccgcaacggcgcctaagnnggccaaggcagggccgccaannagnnttcntgncaagcgggng

SEQ ID NO: 30 - DNA, 416 bp, Zea mays
  unsure (1)..(416): unsure at all n locations
ctcacagaggttcgcaagaatggaacctggccctggctcaggcccgatgggaagacccaggtgacagtggagtaccgcaacgagggtggcgccatggttcccatccgtgtgcacacagtcctcatctctacccagcacgacgagacagtcaccaacgacgagattgctgctgacctgaaggagcacgtcatcaagccagtcatccccgagcagtacctcgacgagaagacaatcttccacctcaacccgtctggccgnttcgtcatcggcggacctnacggcgacgccggcctactggccgnaagatcatcatcgacacctacggtggctggggagcccacggcgggggcgccttcttcggcaaggacccgaccaangtggaccgcacggggcctacgtncgaggnaagcttgcna

SEQ ID NO: 31 - DNA, 484 bp, Zea mays
  unsure (1)..(484): unsure at all n locations
attggtggacctcacggcgatgctggcctcactggccgcaagatcatcattgacacctacgggggctggggagcccatggtggtggcgctttctccggcaaggacccaaccaaggttgaccgcagcggagcctatgtcgcaaggcaggctgccaagagcatcgtcgccagcggccttgctcgccgcgccatcgtccaggtgtcttacgccatcggcgtgcccgagcctctctccgtgttcgtcgacacgtacggcaccggcgcgatccccgacaaggagatcctcaagattgtcaaggagaacttcgatttcaggcctggcatgatcatcatcaaccttgacctcaagaaaggcggcaacgggccgctacctnaagacggcggnctacgggcacttttggaaagggaccaacctgacttnacctgggaaggggtgaaccccttaagtcggagaaacccttttgctaagggggccttttttttaa

SEQ ID NO: 32 - DNA, 477 bp, Zea mays
  unsure (1)..(477): unsure at all n locations
aactttattgccaggcacggtaaangaatcccgggtcgacccacgcgtcngaggaccccccaaggtggaccgcagcggcgcctacgtggccaggcaggccgccaagagcatcgtggccgcggcctcgcccgccgctgcctcgtgcaggtgtcgtacgccatcggtgtgccggagccctgtccgtgttcgtcgactcgtacggcaccggcacgatccccgacaaggagatcctcaagtcgtgaaggagaacttcgacttcaggcccgggatgatcagcatcaacctcgacctgaagagggcggcaacaggttcatcaagaccgccgcttacggccatttcggccgtgacgacgccacttcacctgggaagtggtgaagcccctcaagttcgacaaggcatccggcttaangttggaatnntcaacggtggggcatgaggactaccttcctccnggctctgctgttacctgcaacattg

SEQ ID NO: 33 - DNA, 488 bp, Zea mays
  unsure (1)..(488): unsure at all n locations
ggnnnnnnnnnaactgttacgcntgccggtgccggtccagaattcacgggtcgacccacgcgtccgcgtttgcctcttctccctcttgccgggtcccgaataaagagcagcagcgcaagagtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcaacagtccccgacatcgcgcaaggcgtgcacgggcacttcacgaaac

SEQ ID NO: 34 - DNA, 480 bp, Zea mays
  unsure (1)..(480): unsure at all n locations
ggggnnngnnggtctcttttggccnnnnnnnnnnnnnnnnnnnnnnnnnnnnnnnnnnccacgcntccgcgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcagcagtcccccgacatcgcgcanggcgtgcacgggc

SEQ ID NO: 35 - DNA, 453 bp, Zea mays
  unsure (1)..(453): unsure at all n locations
ccgttcgcctcttctcctccctcctgccgggtccttaataaagagcagcancgcaagaggtnggtagagcgagcgagaagaaggcaatggcggcggagagcttcctgttcacctcggagtccgtgaacgaggggcacccagacaagctgtgcgaccaggtgtcggacgcggtgctggacgcctgcctggcgcangaccccgacagcaaggtggcctgcnagacctgcaccaagacgaacatggtgatggtgttcggcgagatcaccaccaaggcgagcgtggactacgagaagatcgtgcgcgacacctgccgcgagatcgggttcaccttcgacgacgtggggctcgacnccnaccgctgcaaggtgctggtgaacatcgagcagcagtcccccgacatcgcgcaaggcgtgcacggcactttacgaaaccggcccgaggagatcggcccnt

SEQ ID NO: 36 - DNA, 505 bp, Zea mays
  unsure (1)..(505): unsure at all n locations
agggttgttganngttggntanatgananntgcttttacncggtttcggaattcccgggtcgacccacgcgtccgcccgttcgcctcttctnctncctcctgtcgggtccttaataaagagcagcagcgcaagaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcangaccccgacagcaaggtggcctgcgagacctgcaccaagacgaacatggtgatggtgttcggcgagatcaccaccaaggcgagcgtggactacgagaagatcgtgcgcgacacctgccgcgagatcgggttcacctncgacgacgtggggctcgacgccgaccgctgcaaggtgctggtgaacatcgagcancagtcccccgacatcgcgcagggcgtgcacgggcactttacga

SEQ ID NO: 37 - DNA, 447 bp, Zea mays
  unsure (1)..(447): unsure at all n locations
gcagtcccctgatattgctcagggtgtgcacggccacttcaccaagcgncccgaggagattggagctggtgaccaggggcacatgtttgggtatgcgactgacgagacccctgagctgatgcccctcagccatgtccttgccaccaagcttggtgctcgtctcacagaggttcgcaagaatggaacctgcccctggctcaggcccgatgggaagacccaggtgacagtggagtaccgcaacgagggtggcgccatggttcccatccgtgtgcacacagtcctcatctctacccaacacgacgagacangtcaccaacgacgaagattgctgctgacctgaaaggaacaacgtcatcaaaccaagtcatncccgaacagtacctttgacgagaagacaatctttcancttaacccgtctggnccntttgtcatnngnggacctnaacg

SEQ ID NO: 38 - DNA, 420 bp, Zea mays
  unsure (1)..(420): unsure at all n locations
ggncgctttgtcattggtggacctcacggcgatgctggcctcactggccgcaagatcntcatngacacctacggtggctggggagcccatggtggtggcgctttctccggcaaggacccaaccaaggttgaccgcagcggagcctatgtcgcaaggcaggctgccaagagcatcgtcgccagcggccttgctcgccgcgccatcgtccaggtgtcttacgccatcggcgtgcccgagcctctctccgtgttcgtcgacacgtacggcaccggcgcgatccccgacaaggagatcctcaagattgtcaaaggagaacttcgatttcaggcctggcatgatcatcatcaaccttgacctcaagaaaggcggcaacgggcgcttancttaagaacggcggnctacgggcacttttggaangga

SEQ ID NO: 39 - DNA, 499 bp, Zea mays
  unsure (1)..(499): unsure at all n locations
cccatctggccgctttgtcattggtggacctcacggcgatgctggcctcactggccgcaagatcatcattgacacctacggtggctggggagcccatggtggtggcgctttctccggcaaggacccaaccaaggttgaccgcagcggagcctatgtcgcaaggcaggctgccaagagcatcgtcgccagcggccttgctcgccgcgccatcgtccaggtgtcttacgccatcggcgtgcccgagcctctctccgtgttcgtcgacacgtacggcaccggcgcgatccccgacaaggagatcctcaagattgtcaaggagaacttcgatttcaggcctggcatcatcatcaaccttgacctcaagaaaggcggcaacgggcgctacctnaagacggcggcctacggcactttggaagggacgaccctgacttcacctgggaggtggtgaaaccactcaaagtcggagaaaccttntgctaaagcnggcttttttttaaaa

SEQ ID NO: 40 - DNA, 494 bp, Zea mays
  unsure (1)..(494): unsure at all n locations
ggnnnnngnnnnngttaacttntccgccggcaggtaanggtcaagaattcccgggtcgaccacgcgtccgctcnctcttgccggtcccgaataaanagcagcagcgcangaggtcggtgagcgagaagaaggcaatggcggccgagagcttccttttcacctcggantccgtgaacgggggcaccccgacaagctgtgcgaccaggtgtcggacgccgtgcttgacgcatgcctcggcaggaccccgacagcaangtggcctgcgagacctgcaccaagaccaacatggtgatgggttcggcgagatcacgaccaaggcgaccgtggactacgagaagatcgtgcgcgacacctccgcgagatngggttcacctccgacgaactgggcctcnaacgccgaaccgctgcaaggtctggtgaacatcnancagcatttccccgacatcgcgcagggcntgcacgggcacttcacaagcngcccgaggagatcngcg

SEQ ID NO: 41 - DNA, 499 bp, Zea mays
  unsure (1)..(499): unsure at all n locations
gggnttnntntgntgnngatntntggcnnnccggtccggaattcccgggtcgacccacgcgtccgnccacgcgtccgcatcatcgacacgtacggnggctggggagcccacggcggtggcgcctnctccggcaaggaccccaccaaggtggaccgcagcggcgcctacgtggccaggcaggccgccaagagcatcgtggccagcggcctcgcccgccgctgcctcgtgcaggtgtcgtacgccatcggcgtgccggagcccctgtccgtgttcgtcgactcgtacggcaccggcacgatccccgacaaggagatcctcaagatcgtgaaggagaacttcaacttcaggcccgggatgatcagcatcaacctcgacctgaagaanggcggcaacaggttcatcangaccgacgctacggccacttcggccgtgacgacgccgactttacctgggaagtggtgaagccccttaagttccacaaggattnggtttaaggttg

SEQ ID NO: 42 - DNA, 325 bp, Zea mays
  unsure (1)..(325): unsure at all n locations
cccgacggcaagacccaggtgacggtggagtacgtgaacganggcggcgccatggtgcccgtccgcgtgcacaccgtgctcatctccacccagcacgacgagaccgtcaccnaacgacgagatcgccgccgacctcaaggagcacgtcatcaagcccgtcatcccggagaggtacctggacgagaagaccatcttccacctcaacccgtcggggcgcttcgtcatcggcgggccccacggggacgccggcctcaccggccgcaagatcatcatcgacacctacggcggctggggagcccacggcgggggcgccttctccggcaag

SEQ ID NO: 43 - DNA, 319 bp, Zea mays
agcggcccgaggagatcggcgcgggcgaccagggccacatgttcgggtacgccaccgacgagacccccgagctgatgccgctgagccacgtgctggccaccaagctgggcgcgcgcctcaccgaggtgcgcaagaacggcacctgcgcctggctgaggcccgacggcaagacccaggtgacggtggagtacgtgaacgagggcggcgccatggtgcccgtccgcgtgcacaccgtgctcatctccacccagcacgacgagaccgtcaccaacgacgagatcgccgccgacctcaaggagcacgtcatcaagcccgtgat

SEQ ID NO: 44 - DNA, 429 bp, Zea mays
  unsure (1)..(429): unsure at all n locations
ggaacctgcccctggctnaggcccgatgggaagacccaggtgacagtggagtaccgcaacgagggtggcgccatggttcccatccgtgtgcacacagtcctcatctctacccagcacgacgagacagtcaccaacgacgagattgctgctgacctgaaggagcacgtcatcaagccagtcatccccgagcagtacctnnacnagaagacaatcttcacctcaacccgtntggccgcttcgtcatcggcggaccttacggcgacnccggcctnactggccggaaagatcatnatcgacacctacggtggctngggagcccacggcgggggcgccttnttcggcaaggacccgaccaaagttgaccgcaacggggcctacgtngcgaggcaagcttgcaanancatngtnnnccgccgncttnccgcggnc

SEQ ID NO: 45 - DNA, 315 bp, Zea mays
cgggcgaccagggccacatgttcgggtacgccaccgacgagacccccgagctgatgccgctgagccacgtgctggccaccaagctgggcgcgcgcctcaccgaggtgcgcaagaacggcacctgcgcctggctgaggcccgacggcaagacccaggtgacggtggagtacgtgaacgagggcggcgccatggtgcccgtccgcgtgcacaccgtgctcatctccacccagcacgacgagaccgtcaccaacgacgagatcgccgccgacctcaaggagcacgtcatcaagcccgtgatccctgagaagtacctcg

SEQ ID NO: 46 - DNA, 474 bp, Zea mays
  unsure (1)..(474): unsure at all n locations
ggggtcggnngtnattctatantgataanactcanataantnnngnctcntaggaccnttanaannccctagagtnagtcgtttaacggcgggggcgccttctccggcaaggacccgaccaaggtggaccgcagcggggcctacgtcgcgaggcaggctgccaagagcatcgtcgccgccggcctcgcccgccgtgccatcgtccaggtctcctacgccatcggcgtgcccgagcccctgtcggtgttcgtggacacgtacggcaccggcgcgatccccgacaaggagatcctgaagatcgtgaaggagaacttcgacttcaggcccggcatgatcatcatcaacctcgacctcaagaaaggcggcaacgggcgctacctcaagacggcggcctacgggcactttgggagggacgaacccgacttcacctgggaagtngttaaaccccccnaaggcggaaaanccttnttctgg

SEQ ID NO: 47 - DNA, 410 bp, Zea mays
  unsure (1)..(410): unsure at all n locations
gtgcgcgacacctgccgcgagatcgggttcacctccgacgacgtgggcctcgacgccgaccgctgcaaggtgctggtgaacatcgagcagcagtcccccgacatcgcgcanggcgtgcacgggcacttcacgaagcggcccgaggagatcggcgcgggcgaccagggccacatgttcgggtacnccaccgacnagacccccgagctgatgccgctcagccacgtgctggccaccaagctnggcncgcgcctcaccgaggttccgcaagacgggnacctgcgcctggntganggcccgacggcaagaccaaggtnacggtggagtacgtgaactagggcggctccattggtgccctccgcgttcaaaaccgtgctaatntcaccaagnactactaagaccgtnnccaacaa

SEQ ID NO: 48 - DNA, 297 bp, Zea mays
  unsure (1)..(297): unsure at all n locations
ttgcccgtccgcgtgcacaccgtgctcatctccacccagcacgacgagaccgtcaccaacgacgagatcgccgccgacctcaaggagcacgtaatcaagcccgtcatcccgganaggtacctggacgagaagaccatcttccacctcaacccgtcggggcgcttcgtcatcggcgggccccacggggacgccggcctcaccggccgcaagatcatcatcgacacctacggcggctggggagcccacggcgggggcgccttctccggcaaggaccccaccaaggtggaccgcagcggg

SEQ ID NO: 49 - DNA, 438 bp, Zea mays
  unsure (1)..(438): unsure at all n locations
ctggcctcactggccgnaagatcatcatcgacacctacggtggctggggagcccacggcgggggcnccttctccggcaaggacccgaccaaggtggaccgcagcggggcctacgtcgcgaggcaggctgccaagagcatcgtcgccgccggcctcgcccgccgtgccatcgtccaggtctcctacgccatcggcgtgcccgagcccctgtcggtgttcgtggacacntacggcaccggcgcgatccccgacaaggagatcctgaagatcgtgaaggagaacttcgacttcangcccggcatgatcatcatcaacctngacctcaagaaaggcggnnacggnccgctaccttaaanaacggnnggcctacgggcactttgggaagggacnaaccccnatttaacctgggaagtggttnaaccccttaaggcggaaaaaa

SEQ ID NO: 50 - DNA, 316 bp, Zea mays
  unsure (1)..(316): unsure at all n locations
cgtgaacgaggggcacccagacaagctgtgcgaccaggtgtcggacgcggtgctggacgcctgcctggcgcaggaccccgacagcaaggtggcntgcgagacntgcaccaagacgaacatggtgatggtgttcggcgagatcaccaccaaggcgagcgtggactacgagaagatcgtgcgcgacacctgccgcgagatcgggttcacctccgacgacgtggggctcgacgccgaccgctgcaaggtgctggtgaacatcgancagcagtcccccgacntcgcgcagggcgtgcacgggcanttcacgaagcggccc

SEQ ID NO: 51 - DNA, 339 bp, Zea mays
  unsure (1)..(339): unsure at all n locations
acacagtcctcatctctacccagcacgacgagacagtcaccaacgacgagattgctgctgacctgaaggagcacgtcatcaagccagtcatccccgagcagtacctcgacgagaagacaatcttccacctcaacccgtctggccgcttcgtcatcggcggacctcacggcgacgcggctctcactggccggaagatcatcatcgacacctacggtggctggggagcccacggcggggcgccttctccggcaangacccgaccaaggtggaccgcagcggggcctacgtcgcgaggcaggctgccaagagcatcgtcgccgcggcctcgccgcngcgctt

SEQ ID NO: 52 - DNA, 300 bp, Zea mays
agaagatcgtgcgcgacacctgccgcgagatcgggttcacctccgacgacgtgggcctcgacgccgaccgctgcaaggtgctggtgaacatcgagcagcagtcccccgacatcgcgcagggcgtgcacgggcacttcacgaagcggcccgaggagatcggcgcgggcgaccagggccacatgttcgggtacgccaccgacgagacccccgagctgatgccgctgagccacgtgctggccaccaagctgggcgcgcgcctcaccgaggtgcgcaagaacggcacctgcgcctggctgaggc

SEQ ID NO: 53 - DNA, 303 bp, Zea mays
gcccgaggagatcggcgcgggcgaccaggggccacatgttcgggtacgccaccgacgagacccccgagctgatgccgtgagccacgtgctggccaccaagctgggcgcgcgcctcaccgaggtgcgcaagaacggcacctgcgcctggctgaggcccgacggcaagacccaggtgacggtggagtacgtgaacgagggcggcgccatggtgcccgtccgcgtgcacaccgtgctcatctccacccagcacgacgagaccgtcaccaacgacgagatcgccgccgacctcaaggagcacgtcat

SEQ ID NO: 54 - DNA, 477 bp, Zea mays
  unsure (1)..(477): unsure at all n locations
tatttncccgccaggtacaagtcaagaattcccgggtcgacccacgcgtccgcccacgctccgcccacgcgtccgcccacgcgtccggcggggcctacgtcgcgaggcaggctgccaaagcatcgtcgccgccggcctcgcccgccgcgccattgtccaggtctcctacgccatcgggtgcccgagcccctttcggtgttcgtggacacgtacggcaccggcgcgatccccgacaagagatcctgaagatcgtgaaggagaacttcgacttcaggcccggcatgatcatcatcaactcgacctcaagaaaggcggcaacgggcgctacctcaagacggcggcctacgggcacttgggagggacgaccccgacttcacctgggaggtggtgaagcccctcaaggcggaaaaacctcttctgcaagaagggcctcccccggttttggaanaagcttttggtctggtctggtctgtctgg

SEQ ID NO: 55 - DNA, 487 bp, Zea mays
  unsure (1)..(487): unsure at all n locations
ggnnnnngnaantttaaccnctagtaggactgannggtcaggnattcacgggtcganccacgcgtccatgcggctcttctccctcttgccggtcccgaataaagagcagcagcgcaagaggtcggtagagcgagaagaaggcaatggcggccgagagcttccttttcacctcggagtccgtgaacnaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgaagatcacgaccaaggcgaccgtggactacgaagaagatcgtgcgcgacacctgccgcgagatcgggttcacctccgacgacgtgggcctcgacgccgaccgctgcaangtgctgggtgaacatcgagcagcagtcccccgacatcgcgcaaggcgtgcacgggcacttcac

SEQ ID NO: 56 - DNA, 299 bp, Zea mays
  unsure (1)..(299): unsure at all n locations
acctgcaccaagaccaacatggtcatggtctttggtgagatcaccaccaaggccaatgttgactacgagaagattgtcagggagacctgccgcaacattggttttgtgtcaaacgatgttgggcttgacgccgancactgcaaggtgctcgtgaacattgagcagcagtcccctgatattgctcagggtgtgcatggccacttcaccaagcgccccgaggagattggagctggtgaccagggacacatgttcgggtatgcnaccgatgagacccctgagttgatgcccctcagccatgt

SEQ ID NO: 57 - DNA, 315 bp, Zea mays
  unsure (1)..(315): unsure at all n locations
acgatgtcgggcttgacgctgaccactgcaaggtgcttgtgaacattgagcagcagtcccctgatattgctcagggtgtgcacggccacttcaccaagcgccccgaggagattggagctggtgaccaggggcacatgtttgggtatgcgactgacgagacccctgagctgatgcccctcagccatgtccttgccaccaagcttggtgctcgtctcacggnggttcgcaagaatggaacctgcccctggctcaggcccgatgggaagacccaggtgacagtggagtaccgcaacgaaggtggcgcatgggttccca

SEQ ID NO: 58 - DNA, 328 bp, Zea mays
  unsure (1)..(328): unsure at all n locations
cgtctggccgcttcgtcatcggcggacctcacggcgacgctggcctcactggccggaagatcatcatcgacacctacggtggctggggagcccacggcgggggcgccttctccggcaaggacccgaccaaggtggaccgcagcggggcctacgtcgcgaggcaggctgccaagagcatcgtcgccgccggcctcgcccgccgtgccatcgtccaggtctcctacgccatcggcgtgcccgancccctgtcggtgttcgtggacacgtacggcaccggcgcgatccccgacaaggagatcctgaagatcgtgaaggagaattcgacttc

SEQ ID NO: 59 - DNA, 291 bp, Zea mays
  unsure (1)..(291): unsure at all n locations
cgagctgatgccgctgagccacgtgctggccaccaagctcggcgcgcgnctgacggaggtccgcaaggacggcacctgcncctggctcaggcccgacggcaagacccaggtgacggtggagtacgtgaacganggcggcgccatggtgcccgtccgcgtgcacaccgtgctcatctccacccagcacgacgagaccgtcaccaacgacgagatcgccgccgacctcaaggagcacgtcatcaagcccgtcatcccggagaggtacctggacgagaagaccatcttccacct

SEQ ID NO: 60 - DNA, 305 bp, Zea mays
gggtatgcgaccgatgagacccctgagttgatgcccctcagccatgtccttgccaccaagctaggtgctcgtctcaccgaggtccgcaagaacggaacctgcccctggctcaggcctgatgggaagacccaggtgacagtcgagtaccgcaatgagggtggtgccatggtccccatccgtgtccacaccgtcctcatctccacccagcacgacgagacagtgaccaatgatgagatcgctgctgacctgaaggagcatgtcatcaagcctgtcatccctgagcagtaccttgacgagaagaccat

SEQ ID NO: 61 - DNA, 300 bp, Zea mays
  unsure (1)..(300): unsure at all n locations
ggcctgcgagacctgcaccaagaccaacatggtgatggtgttcggcgagatcacgaccaaggcgaccgtggactacgagaagatcgtgcgcgacacctgccgcgagatcgggttcacctccgncgacgtgggcctcgacgccgnccgctgcaaggtgctggtgaacatcgagcagcagtcccccgacatcgcgcagggcgtgcacgggcacttcacgnagcggnccgaggagatnggngcgggcgaccagggncacatgttcgggtacgncaccgacgagacccccgagctgatgccgct

SEQ ID NO: 62 - DNA, 558 bp, Zea mays
  unsure (1)..(558): unsure at all n locations
gnnnngtncccnnnttnnnntntttgncagnacncttnttcgcctgcacgtactcggtccggaattcccgggtcgacccacgcgtccgcccacgcgtccgcccacgcgtccgcccacgcgtccgcccacgcgtccgcccacgcgtccggcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctncgacgacgtgggccttnacgccnaccnntgcaaggtnctggtgaacattgagcaanaattcccnggactttnngcanggcgttcacnggcant

SEQ ID NO: 63 - DNA, 332 bp, Zea mays
gcccctgggctcaggcctgatgggaagacccaggtgacagtcgagtaccgcaatgagggtggtgccatggtccccatccgtgtccacaccgtcctcatctccacccagcacgacgagacagtgaccaatgatgagatcgctgctgacctgaaggagcatgtcatcaagcctgtcatccctgagcagtaccttgacgagaagaccatcttccaccttaacccatctggccgctttgtcatgtggacctcacggcgatgctggcctcactggccgcaagatcatcatgacacctacggtggctggggagcccatggtggtggcgctttctccgg

SEQ ID NO: 64 - DNA, 314 bp, Zea mays
  unsure (1)..(314): unsure at all n locations
ctcggagtctgtgaacgagggacaccctgacaagctctgtgaccaggtctcagatgccgttcttgacgcttgccttgctgaggaccctgacagcaaggttgcttgtgagacctgcaccaagaccaacatggtcatggtctttggtgagatcaccaccaaggccaatgttgactacgagaagattgtcagggagacctgccgcaacattggttttgtgtcaaacgatgttgggcttgacgccgaccactgcaagtgctcgtgaacattnagcagcagtcccctgatattgctcanggtgtgcatggccacttcac

SEQ ID NO: 65 - DNA, 293 bp, Zea mays
ggacgagaagaccatcttccacctcaacccgtcggggcgcttcgtcatcggcgggccccacggggacgccggcctcaccggccgcaagatcatcatcgacacctacggcggctggggagcccacggcgggggcgccttctccggcaaggaccccaccaaggtggaccgcagcggggcctacgtcgccaggcaggccgccaagagcatcgtggccagcggcttcgcccgccgctgcctcgtgcaggtgtcctacgccatcgggtgccggagcccctgtccgtgttcgtcgactc

SEQ ID NO: 66 - DNA, 289 bp, Zea mays
  unsure (1)..(289): unsure at all n locations
gcaaggtggcctgcgagacctgcaccaagacgaacatggtgatggtgttcggcgagatcaccaccaaggcgagcgtggantacgagaagntcgtgcgcgacacctgccgcgagatcgggttcacctccgacgacgtggggctcgacgccgaccgctgcaaggtgctggtgaacatcgagcagcagtcccccgacatcgcgcagggcgtgcacgggcacttcacgaagcggcccgaggagatcggcgccggcgaccagggccacatgttcgggtacgccaccgacgagac

SEQ ID NO: 67 - DNA, 306 bp, Zea mays
gttgactacgagaagattgtcagggagacctgccgcaacattggttttgtgtcaaacgatgttgggcttgacgccgaccactgcaaggtgctcgtgaacattgagcagcagtcccctgatattgctcagggtgtgcatggccacttcaccaagcgccccgaggagattggagctggtgaccagggacacatgttcgggtatgcgaccgatgagacccctgagttgatgcccctcagccatgtccttgccaccaagctaggtgctcgtctcaccgaggtccgcaagaacggaacctgcccctggctc

SEQ ID NO: 68 - DNA, 303 bp, Zea mays
  unsure (1)..(303): unsure at all n locations
tgacaagctctgtgaccaggtctcagatgccgttcttgacgcttgccttgctgaggaccctgacagcaaggttgcttgtgagacctgcaccaagaccaacatggtcatggtctttggtgagatcaccaccaaggccaatgttgactacgagaagattgtcagggagacctgccgcaacattggttttgtgtcaaacgatgttgggcttgacgccgaccactgcaaggtgctcgtgaacattgagcagcagtcccctgatattgctcagggtgngcatggccacttcaccaagcgccccgagga

SEQ ID NO: 69 - DNA, 300 bp, Zea mays
  unsure (1)..(300): unsure at all n locations
caaagaccaacatggtcatggtctttggtgagatcaccaccaaggccaatgtcgactacgagaagattgtcagggagacatgccgcaacattggtttcgtntcgaacgatgtcgggcttgacgctgaccactgcaaggtgcttgtgaacattgagcagcagtcccctgatattgctcagggtgtncacggccacttcaccaagcgccccgaggagattggagctggtgaccaggggcacatgtttgggtatgcgactgacgagacccctgagctgatgcccctcagccatgtccttgcca

SEQ ID NO: 70 - DNA, 329 bp, Zea mays
  unsure (1)..(329): unsure at all n locations
gatcaaagaagatggcagctgtcgacacattcctcttcacctcggagtctgtgaacgagggacaccctgacaagctctgtgaccaggtctcagatgccgttcttgacgcttgccttgctgaggaccctgacagcaaggttgcttgtgagacctgcaccaagaccaacatggtcatggtctttggtgagatcaccaccaaggccaatgttgactacgagaagattgtcagggagacctgccgcaacattggttttgtgtcaaacgatgttgggcttgacgccgaccattgcaaggtgcncgtgaanatnngcancagtcccctgatattg

SEQ ID NO: 71 - DNA, 304 bp, Zea mays
  unsure (1)..(304): unsure at all n locations
gctgaggaccctgacagcaaggntgcttgcnaganctgcaccaagaccaacatggtcatggtctttggngagatcaccaccaaggccaatgtcgactacgagaagattgtcagggagacatgccgcaacattggtttcgtgtcgaacgangtcgggcntgangctgaccactgcaaggngcttgtgaacattgagcagcagtcccctgatattgctcagggtgtgcacggccacttcaccaagcgccccgaggagattggagctggtgaccaggggcacatgtttgggtatgcgactnacgaga

SEQ ID NO: 72 - DNA, 307 bp, Zea mays
  unsure (1)..(307): unsure at all n locations
cgcttgccttgctgaggaccctgacagcaaggttgcttgtgagacctgcaccaagaccaacatggtcanggncctttggtgagatcaccaccaaggccaatgttgactacgagaagattgtcagggagacctgccgcaacattggttttgtgtcaaacgatgttgggcttgacgccgaccactgcaaggtgctcgtgaacattgagcagcagtcccctgatattgctcagggtgtgcatggccacttcaccaagcgccccgaggagattggagctggtgaccagggacacatgttcgggtatgcgac

SEQ ID NO: 73 - DNA, 282 bp, Zea mays
gccaccgacgagacccccgagctgatgccgctgagccacgtgctggccaccaagctcggcgcgcgcctgacggaggtccgcaaggacggcacctgcgcctggctcaggcccgacggcaagacccaggtgacggtggagtacgtgaacgagggcggcgccatggtgcccgtccgcgtgcacaccgtgctcatctccacccagcacgacgagaccgtcaccaacgacgagatcgccgccgatctcaaggagcacgtcatcaagcccgtcatcccggagaggtac

SEQ ID NO: 74 - DNA, 320 bp, Zea mays
caagcttggtgctcgtctcacggaggttcgcaagaatggaacctgcccctggctcaggcccgatgggaagacccaggtgacagtggagtaccgcaacgagggtggcgccatggttcccatccgtgtgcacacagtcctcatctctacccagcacgacgagacagtcaccaacgacgagattgctgctgacctgaaggagcacgtcatcaagccagtcatccccgagcagtacctcgacgagaagacaatcttccacctcaacccgtctggccgcttcgtcatcggcggactcacggcgacctggcctcactggccggaag

SEQ ID NO: 75 - DNA, 370 bp, Zea mays
  unsure (1)..(370): unsure at all n locations
agagcatcgtggccagcggcctcgcccgccgctgcctcgtgcaggtgtcctacgccatnggcgtgccggagcccctgtcagtgttcgtcgactcctacggcaccgggaccatccccgacaaggagatcctcaagatcgtcaaggagaacttcgacttcaggcccgggatgatcaccatcaacctcgacctcaagaagggcggcaacaggttcatcaagaccgccgcatacggccactttggccgtgacgacgccgacttcacctgggaggtggtcaagcccctaaagaaggcatccgcttaagaatgtattgggaagttcactggacatgaggttcatcttcgtctggctctgctgatacctgcaaggat

SEQ ID NO: 76 - DNA, 300 bp, Zea mays
atggaacctgcccctggctcaggcccgatgggaagacccaggtgacagtggagtaccgcaacgagggtggcgccatggttcccatccgtgtgcacacagtcctcatctctacccagcacgacgagacagtcaccaacgacgagattgctgctgacctgaaggagcacgtcatcaagccagtcatccccgagcagtacctcgacgagaagacaatcttccacctcaacccgtctggccgcttcgtcatcggcggacctcacggcgacgctggcctcactggccggaagatcatcatcgaca

SEQ ID NO: 77 - DNA, 315 bp, Zea mays
  unsure (1)..(315): unsure at all n locations
ctcagatgccgttcttgacgcttgccttgctgaggaccctgacagcaaggttgcttgtgagacctgcaccaagaccaacatggtcatggtctttggtgagatcaccaccaaggccaatgttgactacgagaagattgtcagggagacctgccgcaacattggttttgtgtcaaacgatgttgggcttgacgccgaccactgcaaggtgctcgtgaacattgagcagcagtcccctgatattgctcagggtgtgcatggccattcaccaagcgccccgangagattggagctggtgaccaggacacatgttcgggg

SEQ ID NO: 78 - DNA, 297 bp, Zea mays
ctcttcacctcggagtctgtgaacgagggacaccctgacaagctctgtgaccaggtctcagatgccgttcttgacgcttgccttgctgaggaccctgacagcaaggttgcttgtgagacctgcaccaagaccaacatggtcatggtctttggtgagatcaccaccaaggccaatgttgactacgagaagattgtcagggagacctgccgcaacattggttttgtgtcaaacgatgttgggcttgacgccgaccactgcaagtgctcgtgaacattgagcagcagtcccctgatattg

SEQ ID NO: 79 - DNA, 448 bp, Zea mays
  unsure (1)..(448): unsure at all n locations
ttggtnagatcaccaccaaggccaatgttgactacganaagattgtnaggganacctgtcgcnacattggttttgtgtcaaacgatgttgggcttgacgccgaccactgcaaggtgctcgtgaacattnagcagnagtnccctgatattgctcanggtgtgcatggccacttnaccaancgccccgangagattgganctggtgaccagggacacatgttcgggtatgcgaccgatgagacccctnagttgatgcccctcagccatgtccttgccaccaagctaggtgctcgtctnaccgaggtncncaagaaccggaacctgccnctggctcangcctgatgngaagaccnatgtgacagtcnantnncgnaatgaagggtggtgccattgtncccatcctngtcaacaccgttcttatttcaaccaagtnngacgaggacaatgac

SEQ ID NO: 80 - DNA, 287 bp, Zea mays
caccgtcctcatctccacccagcacgacgagacagtgaccaatgatgagatcgctgctgacctgaaggagcatgtcatcaagcctgtcatccctgagcagtaccttgacgagaagaccatcttccaccttaacccatctggccgctttgtcattggtggacctcacggcgatgctggcctcactggccgcaagatcatcattgacacctacggtggctggggagcccatggtggtggcgctttctccggcaaggacccaaccaaggttgaccgcagcggagctatgt

SEQ ID NO: 81 - DNA, 290 bp, Zea mays
gcaatgagggtggtgccatggtccccatccgtgtccacaccgtcctcatctccacccagcacgacgagacagtgaccaatgatgagatcgctgctgacctgaaggagcatgtcatcaagcctgtcatccctgagcagtaccttgacgagaagaccatcttccaccttaacccatctggccgctttgtcattggtggacctcacggcgatgctggcctcactggccgcaagatcatcattgacacctacggtggctggggagcccatggtggtggcgctttctccggcaag

SEQ ID NO: 82 - DNA, 287 bp, Zea mays
  unsure (1)..(287): unsure at all n locations
tggacgcctgcctggcgcaggaccccgacagcaaggtggcctgcgagacctgcaccaagacgaacatggtgatggtgttcggcgagatcaccaccaaggcgagcgtggactacgagaagatcgtgcgcgacacctgccgcgagatcgggnnnacctccgacgacgtggggctcgacgccgaccgctgcaaggtgctggtgaacatcgagcagcagtcccccgacatcgcgcagggcgtgcacgggcacttcacgaagcggcccgaggagatcggcgccggcgaccag

SEQ ID NO: 83 - DNA, 291 bp, Zea mays
atgcccctcagccatgtccttgccaccaagctaggtgctcgtctcaccgaggtccgcaagaacggaacctgcccctggctcaggcctgatgggaagacccaggtgacagtcgagtaccgcaatgagggtggtgccatggtccccatccgtgtccacaccgtcctcatctccacccagcacgacgagacagtgaccaatgatgagatcgctgctgacctgaaggagcatgtcatcaagcctgtcatccctgagcagtaccttgacgagaagaccatcttccaccttaaccca

SEQ ID NO: 84 - DNA, 283 bp, Zea mays
tgccgctgagccacgtgctggccaccaagctgggcgcgcgcctcaccgaggtgcgcaagaacggcacctgcgcctggctgaggcccgatcggcaagacccaggtgacggtggagtacgtgaacgagggcggcgccatggtgcccgtccgcgtgcacaccgtgctcatctccacccagcacgacgagaccgtcaccaacgacgagatcgccgccgacctcaaggagcacgtcatcaagcccgtgatccctgagaagtacctcgacgagaagaccatcttccacc

SEQ ID NO: 85 - DNA, 274 bp, Zea mays
cgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacaccgaccgctgcaaggtgctggtgaacatcgagcagcagtccccc

SEQ ID NO: 86 - DNA, 290 bp, Zea mays
  unsure (1)..(290): unsure at all n locations
ggagcacgtcatcaagccagtcatccccgagcagtacctcgacgagaagacaatcttccacctcaacccgtctggccgcttcgtcatnggcggacctcacggcgacgctggcctcactggccggaagatcatcatcgacacctacggtggctggggagcccacggcgggggcgccttctccggcaaggacccgaccaaggtggaccgcagcggggcctacgtcgcgaggcaggctgccaagagcatcgtcgccgccggcctcgcccgcngtgccatcgtccaggtctcct

SEQ ID NO: 87 - DNA, 290 bp, Zea mays
gtcgacacattcctcttcacctcggagtctgtgaacgagggacaccctgacaagctctgtgaccaggtctcagatgccgttcttgacgcttgccttgctgaggaccctgacagcaaggttgcttgtgagacctgcaccaagaccaacatggtcatggtctttggtgagatcaccaccaaggccaatgttgactacgagaagattgtcagggagacctgccgcaacattggttttgtgtcaaacgatgttgggcttgacgccgaccactgcaaggtgctcgtgaacattga

SEQ ID NO: 88 - DNA, 288 bp, Zea mays
  unsure (1)..(288): unsure at all n locations
gcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcactncgacgacgtgggcctcgacgccgaccgctgcaagnngctngtgaact

SEQ ID NO: 89 - DNA, 289 bp, Zea mays
gcgactgacgagacccctgagctgatgcccctcagccatggttcccatccgtgtgcacacagtcctcatctctacccagcacgacgagacagtcaccaacgacgagattgctgctgacctgaaggagcacgtcatcaagccagtcatccccgagcagtacctcgacgagaagacaatcttccacctcaacccgtctggccgcttcgtcatcggcggacctcacggcgacgctggcctcactggccggaagatcatcatcgacacctacggtggctggggagcccacggc

SEQ ID NO: 90 - DNA, 330 bp, Zea mays
ccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacgcc

SEQ ID NO: 91 - DNA, 291 bp, Zea mays
gtgctcgtctcaccgaggtccgcaagaacggaacctgcccctggctcaggcctgatgggaagacccaggtgacagtcgagtaccgcaatgagggtggtgccatggtccccatccgtgtccacaccgtcctcatctccacccagcacgacgagacagtgaccaatgatgagatcgctgctgacctgaaggagcatgtcatcaagcctgtcatccctgagcagtaccttgacgagaagaccatcttccaccttaacccatctggccgctttgtcattggtggacctcacggcg

SEQ ID NO: 92 - DNA, 285 bp, Zea mays
gccagcggcctcgcccgccgctgcctcgtgcaggtgtcctacgccatcggcgtgccggagcccctgtccgtgttcgtcgactcctacggcaccgggaccatccccgacaaggagatcctaaagatcgtcaaggagaacttcgacttcaggccagggatgatcaccatcaacctcgacctcaagaagggcggcaacaggttcatcaagaccgccgcatacggccactttggccgtgacgacgccgacttcacctgggaggtggtcaagcccctaaagaaggcatcc

SEQ ID NO: 93 - DNA, 283 bp, Zea mays
ggccacttcaccaagcgccccgaggagattggagctggtgaccagggacacatgttcgggtatgcgaccgatgagacccctgagttgatgcccctcagccatgtccttgccaccaagctaggtgctcgtctcaccgaggtccgcaagaacggaacctgcccctggctcaggcctgatgggaagacccaggtgacagtcgagtaccgcaatgagggtggtgccatggtccccatccgtgtccacaccgtcctcatctccacccagcacgacgagacagtgacca

SEQ ID NO: 94 - DNA, 298 bp, Zea mays
  unsure (1)..(298): unsure at all n locations
actacgagaagattgtcagggagacatgccgcaacattggtttcgtgtcgaacgatgtcgggcttgacgctgaccactgcaaggtgcttgtgaacattgagcagcagtcccctgatattgctcagggtgtgcacggccacttcaccaagcgccccgaggagattggagctggtgaccaggggcacatgtttgggtatgcnactgacgagacccctgagctgatgcccctcagccatgtccttgccaccaagcttggtgtcgtctcacngaaggttcgcaagaatggaacctgccccnt

SEQ ID NO: 95 - DNA, 469 bp, Zea mays
  unsure (1)..(469): unsure at all n locations
cttctccctcttgccggtcccgaataaagagcagcagcgcaagaggtcggtagagcgagaagaaggcaatggcggccgagagcttccttttcacctcggagtccgtgaacgaggggcaccccgacaagctgtgcnaccaggtgtcggacgccgtgcttgacncatgcctcgcgcaggaccccnacagcaaggtggcctgcnagacctgcaccaanaccaacatggtgatggtgttcggcgagatcacgaccaangcgaccgtggactacgagaagatcgtgcgccgacacctgccgcgagatcgggttcaccttcgncgacgtgngcccttgactccnncccggtgcaaggtgctggtgaacattnatcatcaatnccccgacattnntcaaggcnttcacggcactttacgaaacggcccnangagatcggccgggccaacagngccacatnttcgggtcccccccca

SEQ ID NO: 96 - DNA, 293 bp, Zea mays
  unsure (1)..(293): unsure at all n locations
aacgatgttgggcttgacgccgaccactgcaaggtgctcgtgaacattgagcagcagtcccctgattgctcagggtgtgcatggccacttcaccaagcgccccgaggagattggagctggtgaccagggacacatgttcgggtatgcnaccgatgagacccctgagttgatgcccctcagccatgtccttgccaccaagctaggtgctcgtctcaccgaggtccgcaagaacggaacctgcccctggctcaggcctgatgggaagacccaggtgacagtcgagtaccgcaaaa

SEQ ID NO: 97 - DNA, 280 bp, Zea mays
  unsure (1)..(280): unsure at all n locations
cggnacgntggcgtgaacgaggggcacccagacaagctgtgcgaccaggtgtcggacgcggtgctggacgcctgcctggcgcaggancccgacagcaaggtggcctgcgagacctgcaccaagacgaacatggtgatggtgttcggcgagatcaccaccaaggcgagcgtggactacgagaagatcgtgcgcgacacctgccgcgagatcgggttcacctccgacgacgtggggctcgacgccgaccgctgcaaggtgctggtgaacatcgagcagcagt

SEQ ID NO: 98 - DNA, 285 bp, Zea mays
catggtggtggcgctttctccggcaaggacccaaccaaggttgaccgcagcggagcctatgtcgcgaggcaggctgccaagagcatcgtcgccagcggccttgctcgccgcgccatcgtccaggtgtcttacgccatcggcgtgcccgagcctctctccgtgttcgtcgacacgtacggcaccggcgcgatccccgacaaggagatcctcaagattgtcaaggagaacttcgatttcaggcctggcatgatcatcatcaaccttgacctcaagaaaggcggcaag

SEQ ID NO: 99 - DNA, 278 bp, Zea mays
  unsure (1)..(278): unsure at all n locations
aggtgacagtcgagtaccgcaatgagggtggtgccatggtccccatncgtgtccacaccgtcctcatctccacccagcacgacgagacagtgaccaatgatgagatcgctgctgacctgaaggagcatgtcatcaagcctgtcatncctgagcagtaccttgacgagaagaccatcttccaccttaacccatctggccgctttgtcattggtggacctcacggcgatgctggcctcactggccgcaagatcatcattgacacctacggtggctgggga

SEQ ID NO: 100 - DNA, 275 bp, Zea mays
  unsure (1)..(275): unsure at all n locations
gtgaccaatgatgagatcgctgctgacctgaaggagcatgtcatcaagcctgtcatccctgagcagtaccttgacgagaagaccatcttccaccttaacccatctggccgctttgtcattggtggacctcacggcgatgctggcctcactggccgcaagatcatcattgacacctacggtggctggggagcccatggtggtggcgctttctccggcaaggacccaaccaaggttgaccgcagcggancctatgtcgcaaggcaggctgccaagag

SEQ ID NO: 101 - DNA, 291 bp, Zea mays
gatcgctgctgacctgaaggagcatgtcatcaagcctgtcatccctgagcagtaccttgacgagaagaccatcttccaccttaacccatctggccgctttgtcattggtggacctcacggcgatgctggcctcactggccgcaagatcatcattgacacctacggtggctggggagcccatggtggtggcgctttctccggcaaggacccaaccaaggttgaccgcagcggagcctatgtcgcaaggcaggctgccaagagcatcgtcgccagcggcttgctcgccgcgcc

SEQ ID NO: 102 - DNA, 301 bp, Zea mays
agaagatggccggactcgacaccttcctcttcacctcggagtccgtgaacgagggacaccctgacaagctctgcgaccaggtctcagatgctgttctggacgcttgcctgctgaggaccctgacagcaaggttgcttgcgagacctgcaccaagaccaacatggtcatggtctttggtgagatcaccaccaaggccaatgtcgactacgagaagattgtcagggagacatgccgcaacattggtttcgtgtcgaacgatgtcgggcttgacgctgaccactgcaagtgcttgtgaacattg

SEQ ID NO: 103 - DNA, 336 bp, Zea mays
  unsure (1)..(336): unsure at all n locations
ctccctcttgccggtcccgaataaagagcagcagcgcaagaggtcggtagagcgagaagaaggcaatggcggccgagagcttccttttnacctcggagtccgtgaaacgaggggcnccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacgccgac

SEQ ID NO: 104 - DNA, 276 bp, Zea mays
tgagaagtacctcgacgagaagaccatcttccacctcaacccgtccgggcgcttcgtcatcggcgggccccacggtgacgccggcctcaccggccgcaagatcatcatcgacacgtacggcggctggggagcccacggcggtggcgccttctccggcaaggaccccaccaaggtggaccgcagcggcgcctacgtggccaggcaggccgccaagagcatcgtggccagcggctcgcccgccgctgcctcgtgcagtgtcgtacgccatcgctgccg

SEQ ID NO: 105 - DNA, 287 bp, Zea mays
gagattggagctggtgaccagggacacatgttcgggtatgcgaccgatgagacccctgagttgatgcccctcagccatgtccttgccaccaagctaggtgctcgtctcaccgaggtccgcaagaacggaacctgcccctggctcaggcctgatgggaagacccaggtgacagtcgagtaccgcaatgagggtggtgccatggtccccatccgtgtccacaccgtcctcatctccacccagcacgacgagacagtgaccaatgatgagatcgtgctgacctgaaggag

SEQ ID NO: 106 - DNA, 303 bp, Zea mays
  unsure (1)..(303): unsure at all n locations
accgtcctcatctccacccagcacgacgagacagtgaccaatgatgagatcgctgctgacctgaaggagcatgtcatcaagcctgtcatccctgagcagtaccttgacgagaagaccatcttccaccttaacccatctggccgctttgtcattggtggacctcacggcgatgctggcctcactggccgcaagatcatcattgacacctacggtggctggggagcccatggtggtggcgctttctccggcaaggacccaaccaagttgaccgcagcgganctatgtcgcaaggcagctgccaag

SEQ ID NO: 107 - DNA, 279 bp, Zea mays
  unsure (1)..(279): unsure at all n locations
gtgaccaggtctcagatgccgttcttgacgcttgccttgctgaggaccctgacagcaaggttgcttgtgagacctgcaccaagaccaacatggtcatggtctttggtgagatcaccaccaaggccaatgttgactacgagaagattgtnagggagacctgccgcaacattggttttgtgtcaaacgatgttgggcttgacgccgaccactgcaaggtgctcgtgaacattgagcagcagtcccctgatattgctcagggtgtgcatggccacttcacca

SEQ ID NO: 108 - DNA, 330 bp, Zea mays
ctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcct

SEQ ID NO: 109 - DNA, 298 bp, Zea mays
  unsure (1)..(298): unsure at all n locations
ccgacggcaagacccaggtgacggtggagtacgtgaacnanggcggcgccatggtgcccgtccgcntgcacaccgtgctcatctccacccagcacgacgagaccgtcaccaangacgagntcgccgccgncctcanggagcacgtcntnaagcccgtcatcccgganaggtacctggacganaagaccntcttncacctcaacccgtcgggggcgnttcgtcntcggcgggccccacggggacnccggcctnaccggccgcaagntgntcntngncacctacngcggntggggagccc

SEQ ID NO: 110 - DNA, 498 bp, Zea mays
  unsure (1)..(498): unsure at all n locations
cccctctttngcctatccgggccgacccacgcgncacgcggnggctcngngcgtatcgagcccacggattttggcntctnctccggcaaggaccccaccnnggtgggggngnattgggncctaccgtcgccaggcangccgacaagagcatngnggccagcggcctcgcncgccgntgcctcgngcaggtgtcctacgccatcggcgtgccggagcccctgtccgtgttcgtngactcctacggcaccgggaccatccccgacaaggagatcctaaagatcgtnaaggagaacttcgacttcaggccagggatggtcaccatcaacctcgacctcaagaagggcggcaacaggttcatcaagaccgccgnatacggccactttggcccgtgacgacgccgacttcacctgggaggtggtcaagcccctaaagaaggcatccgcttaagaatgtattgngaaagttcactggacatgaaggatcatcttcctctnggct

SEQ ID NO: 111 - DNA, 284 bp, Zea mays
gcccgcagatcaaagaagatggcagctgtcgacacattcctcttcacctcggagtctgtgaacgagggacaccctgacaagctctgtgaccaggtctcagatgccgttcttgacgcttgccttgctgaggaccctgacagcaaggttgcttgtgagacctgcaccaagaccaacatggtcatggtctttggtgagatcaccaccaaggccaatgttgactacgagaagattgtcagggagacctgccgcaacattggttttgtgtcaaacgatgttgggcttga

SEQ ID NO: 112 - DNA, 328 bp, Zea mays
  unsure (1)..(328): unsure at all n locations
ggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcagcagtcccccgacatcgcgcagggcgtgcacgggcacttcacgaagcggcccgaggagatcggcgcgggnnaccagggccacatgttcgggtacgccaccgacgagacccccgagctgatgccgctgagccaacgtgctggccaacaagctgggcgcggggctcaccgangtgcgaaaaacggcaactgcgctggct

SEQ ID NO: 113 - DNA, 287 bp, Zea mays
gggggcgccttctccggcaaggacccgaccaaggtggaccgcagcggggcctacgtcgcgaggcaggctgccaagagcatcgtcgccgccggcctcgcccgccgcgccattgtccaggtctcctacgccatcggcgtgcccgagcccctttcggtgttcgtggacacgtacggcaccggcgccatccccgacaaggagatcctgaagatcgtgaaggagaacttcgacttcaggcccggcatgatcatcatcaacctcgacctcaagaaaggcggcaacgggcgcta

SEQ ID NO: 114 - DNA, 261 bp, Zea mays
cgacgccgaaccgctgcaaggtgctggtgaacatcgagcagcagtcccccgacatcgcgcagggcgtgcacgggcacttcacgaagcggcccgaggagatcggcgcgggcgaccagggccacatgttcgggtacgccaccgacgagacccccgagctgatgccgctgagccacgtgctggccaccaagctgggcgcgcgcctcaccgaggtgcgcaagaacggcacctgcgcctggctgaggcccgacggcaagacccagg

SEQ ID NO: 115 - DNA, 294 bp, Zea mays
  unsure (1)..(294): unsure at all n locations
gggccacttcaccaagcgccccgaggagattggagctggtgaccagggacacatgttcgggtatgcgaccgatgagacccctgagttgatgcccctcagccatgtccttgccaccaagctaggtgctcgtctcaccgaggtccgcaagaacggaanctgcccctggctcaggcctgatgggaagacccaggtgacagtcgagtaccgcaatgagggtggtgccatggtccccatccgtgtccacaccgtcctcatctccacccagcacgacgagacatgaccaatgatgagatc

SEQ ID NO: 116 - DNA, 318 bp, Zea mays
  unsure (1)..(318): unsure at all n locations
ctgaaggagcacgtcatcaagccagtcatccccgagcagtacctcgacgagaagacaatcttccacctcaacccgtctggncgcttcgtcatcggcggacctcacggcgacgccggcctcactggccggaagatcatcatcgacacctacggtggctggggagcccacggcgggggcgccttctccggcaaggacccgaccaangtggaccgcagcggggcctacgtcgcgangcaggctgccaagagcatcgtcgccgccggcctcgccgcngcgccatcgtccaggtctctagcatgggtgccgancctatcgtgt

SEQ ID NO: 117 - DNA, 256 bp, Zea mays
gagaagtacctcgacgagaagaccatcttccacctcaacccgtccgggcgcttcgtcatcggcgggccccacggtgacgccggcctcaccggccgcaagatcatcatcgacacgtacggcggctggggagcccacggcggtggcgccttctccggcaaggaccccaccaaggtggaccgcagcggcgcctacgtggccaggcaggccgccaagagcatcgtggccagcggcttcgcccgccgctgccttctgcaag

SEQ ID NO: 118 - DNA, 275 bp, Zea mays
  unsure (1)..(275): unsure at all n locations
gtcgacacattcctcttcacctcggagtctgtgaacgagggacaccctgacaagctctgtgaccaggtctcagatgccgttcttgacgcttgccttgctgaggaccctgacagcaaggttgcttgtgagacctgcaccaagaccaacatggtcatggtctttggtgagatcaccaccaaggncnatgttgactacgagaagattgtcagggagacctgccgcaacattggttttgtgtcaaacgatgttgggcttgacgccgaccactgcaaggt

SEQ ID NO: 119 - DNA, 276 bp, Zea mays
  unsure (1)..(276): unsure at all n locations
gtcgacacattcctcttcacctcggagtctgtgaacgagggacaccctgacaagctctgtgaccaggtctcagatgccgttcttgacgcttgccttgctgaggaccctgacagcaaggttgcttgtgagacctgcaccaagaccaacatggtcatggtctttggtgagatcaccaccaaggccattgttgactacgagaagattgtcagggagacctgccgcaacattggttttgtgtcaaacgatgttgggcntgacgccgaccactgcaaggtg

SEQ ID NO: 120 - DNA, 309 bp, Zea mays
  unsure (1)..(309): unsure at all n locations
cggcacggtggtcgcagcatcgctgctgacctgaaggagcatgtcatcaagcctgtnatccctgagcagtaccttgacgagaagaccatnttccaccttaacccatctggccgctttgtcattggtggacctcacggcgatgctggcctcactggccgcaagatcatcattgacacctacggtggctggggagcccatggtggtggcgctttctccggcaaggacccaaccaaggttgaccgcagcggagcctatgtcgcaangcangctgccaagagcatcgtcgccaacggcttgctcgccgcgcca

SEQ ID NO: 121 - DNA, 267 bp, Zea mays
ctcagggtgtgcatggccacttcaccaagcgccccgaggagattggagctggtgaccagggacacatgttcgggtatgcgaccgatgagacccctgagttgatgcccctcagccatgtccttgccaccaagctaggtgctcgtctcaccgaggtccgcaagaacggaacctgcccctggctcaggcctgatgggaagacccaggtgacagtcgagtaccgcaatgagggtggtgccatggtccccatccgtgtccacaccgtcctca

SEQ ID NO: 122 - DNA, 277 bp, Zea mays
  unsure (1)..(277): unsure at all n locations
gcaaggtgcttgtgaacattgagcagcagtcccctgatattgctcagggtgtgcacggccacttcaccaagcgccccgaggagattggagctggtgaccaggggcacatgtttgggtatgcgactgacgagacccctgagctgatgcccctcagccatgtccttgccaccaagcttggtgctcgtctcacggaggttcgcaagaatggaacctgcccctggctcaggcccgatgggaagacccagtgacaattggantaccgcaacgagggtggccc

SEQ ID NO: 123 - DNA, 264 bp, Zea mays
gccacatgttcgggtacgccaccgacgagacccccgagctgatgccgctgagccacgtgctggccaccaagctgggcgcgcgcctcaccgaggtgcgcaagaacggcacctgcgcctggctgaggcccgacggcaagacccaggtgacggtggagtacgtgaacgagggcggcgccatggtgcccgtccgcgtgcacaccgtgctcatctccacccagcacgacgagaccgtcaccaacgacgagatcgcccgccgacctcaag

SEQ ID NO: 124 - DNA, 269 bp, Zea mays
gaagattgtcagggagacctgccgcaacattggttttgtgtcaaacgatgttgggcttgacgccgaccactgcaaggtgctcgtgaacattgagcagcagtcccctgatattgctcagggtgtgcatggccacttcaccaagcgccccgaggagattggagctggtgaccagggacacatgttcgggtatgcgaccgatgagacccctgagttgatgcccctcagccatgtccttgccaccaagctaggtgctcgtctcaccgaggtcc

SEQ ID NO: 125 - DNA, 274 bp, Zea mays
  unsure (1)..(274): unsure at all n locations
atgccgctgagccacgtgctggccaccaagctgggcgcgcgnctcaccgaggtgcgcaagaacggcacctgcgcctggctgaggcccgacggcaagacccaggtgacggtggagtacgtgnacgagggcggcgccatggtgcccgtccgcgtgcacaccgtgctcatctccacncancangnngngntngtcaccaacnacgagatcgccgccgacctcaaggagcacgtcatcaagcccgtgatccctgagaagtacctcgacgagaagacca

SEQ ID NO: 126 - DNA, 260 bp, Zea mays
  unsure (1)..(260): unsure at all n locations
ggaccctgacagcaaggttgcttgcgagacctgcaccaagaccaacatggtcatggnctttggtgagatcaccaccaaggccaatgtcgactacgagaagattgtcagggagacatgccgcaacattggtttcgtgtcgaacgatgtcgggcttgacgctgaccactgcaaggtgcttgtgaacattgagcagcagtcccctgatattgctcagggtgtgcacggccacttcaccaagcgccccgaggagattggagctg

SEQ ID NO: 127 - DNA, 516 bp, Zea mays
  unsure (1)..(516): unsure at all n locations
gnnnaaaggagatttgatangntttntggggaggnanagntnatgccgtaccggtccggaattcccgggtcgacccacgcgtccggagaagaccatcttccacctcaacccgtccgggcgcttcgtcatcggcgggccccagggtgacgccggcctcaccggccgcaagatcatcatcgacacgtacggcggctggggagcccacggcggtggcgccttctccggcaaggaccctaccaaggtggaccgcagcggcgcctacgtggccaggcaggccgntcangagcatcgtggccagcggcctcncccgccgctgnctcgtgcaggtgtcgtacgcnatcggcgtgcacggagcccntgtatcgtattcgtaactcgtacggaacnggnacgatncnnganaaggatatactanangatagtgaaggagaantnntncttnatgcnnnngttgatnaggatnnaanntnnannngnnnaangttnnnnnnnggnnnattnnnnantntnnnnnta

SEQ ID NO: 128 - DNA, 264 bp, Zea mays
  unsure (1)..(264): unsure at all n locations
ggagcatgtcatcaagcctgtcatccctgagcagtaccttgacgagaagaccatcttccaccttaacccatctggccgctttgtcattggtggacctcacggcgatgctggcctcactggccgcaagatcatcattgacacctacggtggctggggagcccatggtggtggcgctttctccggcaaggacccaaccaaggttgaccgcagcggagcctatgtcgcaangcaggctgccaagagcatcgtcgccagcggccttgc

SEQ ID NO: 129 - DNA, 270 bp, Zea mays
caagaatggaacctgcccctggctcaggcccgatgggaagacccaggtgacagtggagtaccgcaacgagggtggcgccatggttcccatccgtgtgcacacagtcctcatctctacccagcacgacgagacagtcaccaacgacgagattgctgctgacctgaaggagcacgtcatcaagccagtcatccccgagcagtacctcgacgagaagacaatcttccacctcaacccgtctggccgcttcgtcatcggcggacctcacggcga

SEQ ID NO: 130 - DNA, 249 bp, Zea mays
cacgtcatcaagcccgtgatccctgagaagtacctcgacgagaagaccatcttccacctcaacccgtccgggcgcttcgtcatcggcgggccccacggtgacgccggcctcaccggccgcaagatcatcatcgacacgtacggcggctggggagcccacggcggtggcgccttctccggcaaggaccccaccaaggtggaccgcagcggcgcctacgtggccaggcaggccgccaagagcatcgtggcc

SEQ ID NO: 131 - DNA, 270 bp, Zea mays
gtcatcaagcctgtcatccctgagcagtaccttgacgagaagaccatcttccaccttaacccatctggccgctttgttattggtggacctcacggcgatgctggcctcactggccgcaagatcatcattgacacctacggtggctggggagcccatggtggtggcgctttctccggcaaggacccaaccaaggttgaccgcagcggagcctatgtcgcaaggcaggctgccaagagcatcgtcgccagcggccttgctcgccgcgccatc

SEQ ID NO: 132 - DNA, 265 bp, Zea mays
  unsure (1)..(265): unsure at all n locations
ctgcancaagaccaacatggtcatggtctttggtgagatcaccaccaaggccaatgttgactacgagaagattgtcagggagacctgccgcaacattggttttgtgtcaaacgatgttgggcttgacgccgaccactgcaaggtgctcgtgaacattgagcagcagtcccctgatattgctcagggtgtgcanggccacttcaccaagcgccccgaggagattggagctggtgaccagggacacatgttcgggtatgcgaccgat

SEQ ID NO: 133 - DNA, 284 bp, Zea mays
  unsure (1)..(284): unsure at all n locations
accggccgcaagatcatcatcgacacgtacggcggctggggagcccacggcggggngccttctccggcaaggaccccaccaaggtggaccncagcggcgcctacgtggccaggcaggccgccaagagcatcgtngccagcngcctcgcccgccgctgcctcgtgcaggtgtcgtacgccatcggntgccggagcncctgtccgtgttcgtcaactcgtacggcaccggcacgatccccgacaaggagatcctcaagatcgtgaaggagnattcgattcaggccg

SEQ ID NO: 134 - DNA, 429 bp, Zea mays
  unsure (1)..(429): unsure at all n locations
gggagacatgccgcaacattggtttcgtgtcgaacgatgtcgggcttgacgctgaccactgcaaggtgcttgtgaacattgagcagcagtcccctgatattgctcagggtgtgcacggccacttaccaagcgccccgaggagattggagctggtgaccaggggcacatgtttgggtatgcgactgacgagacccctgagctgatgcccctcagccatgtncttgccaccaagcttggtgctcgtctnacaaangntcgcaagaaatggaacctggcccctggcttaagcccgatnggnaagacccaagtgacaagtggaatanccgnaaccaagggtggcnccatgggttcccattcgtgtgcacacaagtccttaatttttacccaacaccgaccaaggccagttanccaacgaccagganttggcnt

SEQ ID NO: 135 - DNA, 282 bp, Zea mays
  unsure (1)..(282): unsure at all n locations
atcggcgggccccacggtgacgccggcctcaccggccgcaagatcatcatcgacacgtacggcggctggggagcccacggcggtggcgcnttctccggcaaggaccccaccaaggtggaccgcagcggcgcntacgtggccaggcaggccgccaagagcatcgtngccagcngctcgcncgccgntgcntngtgcaggtgtcgtacgccatcggctgccggagcccctgtccgtgttngtcaactcgtacggcngcggcacgntccccgacaaggagntctc

SEQ ID NO: 136 - DNA, 279 bp, Zea mays
  unsure (1)..(279): unsure at all n locations
gtgatggtgttcggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcagcagtcccccgacatcgcgcagggcgtgcacgggcattcacgaagcggcccgaggagatcggcgcgggcgaccagggccacatgttcgggtacgccaccgacgagacccccgagtgatgccgtnagcnatgtgngc

SEQ ID NO: 137 - DNA, 283 bp, Zea mays
  unsure (1)..(283): unsure at all n locations
ctgagaagtacctcgacgagaagaccatcttccacctcaacccgtccgggcgcttcgtcattggcggggcccaaggtgaaggcgggcttaacgggcggaaanntnntcatcganacgnanggcggttggggagcccacggcggtggcgcnttctccggcaaggaccccaccaaggtggaccgcagcggcgcctacgtggccaggcaggccgccaagagcatcgtggccagcggcttcgcccgcngctgcctcgtgcaggtgtcgtacgccatcgggtgccgga

SEQ ID NO: 138 - DNA, 297 bp, Zea mays
  unsure (1)..(297): unsure at all n locations
cggacntggngaaaggagcacgtcatcaagccagtcatccccgagcagtacctcgacgagannntcaatcttccacctcaacccgtctggccgcttcgtcatcggcggacctcacggcgacgctggcctcactggccggaagatcatcatcgacacctacggtggctggggagcccacggcgggggcgccttctccggcaaggacccgaccaaggtggaccgcagcggggcctacgtcgcgaggcaggctgccaagagcatcgtcgccgcggcctcgcccgccgcgcattgtccagt

SEQ ID NO: 139 - DNA, 317 bp, Zea mays
ctccctcttgccggtcccgaataaagagcagcagcgcaagaggtcggtagagcgagaagaaggcaatggcggccgagagcttccttttcacctcggagtccgtgaacgaggggcacccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacg

SEQ ID NO: 140 - DNA, 277 bp, Zea mays
cgctgcctcgtgcaggtgtcgtacgccatcggcgtggccggagcccctgtccgtgttcgtcaactcgtacggcaccggcacgatccccgacaaggagatcctcaagatcgtgaaggagaacttcgacttcaggcccgggatgatcagcatcaacctcgacctgaagaagggcggcaacaggttcatcaagaccgccgcctacggccacttcggccgtgacgacgccgacttcacctgggaggtggtgaagcccctcaagttcgacaaggcatcgctt

SEQ ID NO: 141 - DNA, 279 bp, Zea mays
ccgagcctctctccgtgttcgtcgacacgtacggcaccggcgcgatccccgacaaggagatcctcaagattgtcaaggagaacttcgatttcaggcctggcatgatcatcatcaaccttgacctcaagaaaggcggcaacgggcgctacctcaagacggcggcctacggccactttggaagggacgaccctgacttcacctgggaggtggtgaagccactcaagtcggagaaaccttctgcctaaggcggcctttttttcagtaagaagcttttggtgg

SEQ ID NO: 142 - DNA, 263 bp, Zea mays
  unsure (1)..(263): unsure at all n locations
caaggttgaccgcagcggagcctatgtcgcaaggcaggctgccaagagcatcgtcgccagcngccttgctcgccgcgccatcgtccaggtgtcttacgccatcggcgtgcccgagcctctctccgtgttcgtcgacacgtacggcaccggcgcgatccccgacaaggagatcctcaagattgtcaaggagaacttcgatttcaggcctggcatgatcatcatcaaccttgacctcaagaaaggcggcaacgggcgctacctca

SEQ ID NO: 143 - DNA, 287 bp, Zea mays
  unsure (1)..(287): unsure at all n locations
cgtcatcaagccagtcatccccgagcagtacctcgacgagaagacaatcttccacctcaacccgtctggccgtttcgtcatcggcggacctcacggcgacgccggcctcactggccggaagatcatcatcgacacctacggtggctggggagcccacggcgggggcgccttctccggcaaggacccgaccaaggtggaccgcagcggggcctacgtcgcgaggcaggctgccaagagcatcgtcgccgccggccttcgcccgcngcgccatcgtccaggtctctaag

SEQ ID NO: 144 - DNA, 280 bp, Zea mays
  unsure (1)..(280): unsure at all n locations
ggccacttcaccaagcgccccgaggagattggagctgntgaccagggacacatgttcgggtatgcgaccgatgagacccctgagttgatgcccctcagccatgtccttgccaccaagctaggtgctcgtctcaccgaggtccgcaagaacggaacctgcccctggctcaggcctgatgggaagacccaggtgacagtcgagtaccgcaatgagggtggtgccatggtccccatccgtgtccacaccgtcctcatctccacccgcacgacgagacagtgac

SEQ ID NO: 145 - DNA, 251 bp, Zea mays
ttcacctccgacgacgtgggcctcgacgccgaccgctgcaaggtgctggtgaacatcgagcagcagtcccccgacatcgcgcagggcgtgcacgggcacttcacgaagcggcccgaggagatcggcgcgggcgaccagggccacatgttcgggtacgccaccgacgagacccccgagctgatgccgctgagccacgtgctggccaccaagctgggcgcgcgcctcaccgaggtgcgcaagaacggcactgg

SEQ ID NO: 146 - DNA, 270 bp, Zea mays
atggtccccatccgtgtccacaccgtcctcatctccacccagcacgacgagacagtgaccaatgatgagatcgctgctgacctgaaggagcatgtcatcaagcctgtcatccctgagcagtaccttgacgagaagaccatcttccaccttaacccatctggccgctttgtcattggtggacctcacggcgatgctggcctcactggccgcaagatcatcattgacacctacggtggctggggagcccatggtggtggcgtttctccggca

SEQ ID NO: 147 - DNA, 310 bp, Zea mays
agacctgccgcaacattggttttgtgtcaaacgatgttgggcttgacgccgaccactgcaaggtgctcgtgaacattgagcagcagtcccctgatattgctcagggtgtgcatggccacttcaccaagcgccccgaggagattggagctggtgaccagggacacatgttcgggtatgcgaccgatgagacccctgagttgatgcccctcagccatgtccttgccaccaagctaggtgctcgtctcaccgaggtccgcaagaacggaactgcccctggctcagcctgatgggaagaccagtgacagtcgag

SEQ ID NO: 148 - DNA, 292 bp, Zea mays
  unsure (1)..(292): unsure at all n locations
ccaggtctcctacgccatcggcgtgcccgagcccctttcggtgttcgtggacacgtacggcaccggcgcgatccccgacaaggagatcctgaagatcgtgaaggagaacttcgacttcaggcccggcatgatcatcatcaacctcgacctcaagaaaggcggcaacgggcgctacctcaagacggcggcctacgggcactttgggagggacgaccccgacttcacctgggaggtggtgaagcccctcaaggcggagaagccgtcttctgcatgaggcgcctcctctgtttng

SEQ ID NO: 149 - DNA, 279 bp, Zea mays
  unsure (1)..(279): unsure at all n locations
aggtgacagtcgagtaccgcaatgagggtggtgccatggtccccatgcgtgtccacaccgtcctcatactccacccagcacgacgagacagtgaccaatgatgagatcgctgctgacctgaaggagcatgtcatcaagcctgtcatcctgagcagtaccttgacgagaagaccatcttccaccttaacncatctggccgctttgtcattggtggacctcacggcgatgctggcctcactggccgcaagatcatcattgacacctacggtggctggggag

SEQ ID NO: 150 - DNA, 322 bp, Zea mays
  unsure (1)..(322): unsure at all n locations
ctccctcttgccggtcccgaataaagagcagcagcgcaagaggtcggtagagcgagaagaaggcaatggcggccgagagcntccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggacnacgagaagatcgtgcgcgacacctgccgcgagatcgggttcactccgacgacgtgggc

SEQ ID NO: 151 - DNA, 283 bp, Zea mays
gaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgg

SEQ ID NO: 152 - DNA, 316 bp, Zea mays
cgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggtt

SEQ ID NO: 153 - DNA, 277 bp, Zea mays
  unsure (1)..(277): unsure at all n locations
gcatggccacttcaccaagcgccccgaggagattngagctggtgaccagggacacatgttccgggtatgcgaccgatgagacccctgagttgatgcccctcagccatgtccttgccaccaagctaggtgctcgtctcaccgaggtccgcaagaacggaacntgcccctggctcagggctgatgggaagacccaggtgacagtcgagtaccgcaatgagggtggtgccatggtccccatccgtgtccacaccgtcctcatctccacccagcacgacga

SEQ ID NO: 154 - DNA, 272 bp, Zea mays
tgtcatcaagcctgtcatccctgagcagtaccttgacgagaagaccatcttccaccttaacccatctggccgctttgtcattggtggacctcacggcgatgctggcctcactggccgcaagatcatcattgacacctacggtggctggggagcccatggtggtggcgctttctccggcaaggacccaaccaaggttgaccgcagcggacctatgtcgcaaggcaggctgccaagagcatcgtcgccagcggccttgctcgccgcgccatcgt

SEQ ID NO: 155 - DNA, 297 bp, Zea mays
  unsure (1)..(297): unsure at all n locations
ccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacnccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatc

SEQ ID NO: 156 - DNA, 267 bp, Zea mays
  unsure (1)..(267): unsure at all n locations
gtcggtagagcgagaagaaggcaatggcggccgagagcttccttttcacntcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacct

SEQ ID NO: 157 - DNA, 261 bp, Zea mays
  unsure (1)..(261): unsure at all n locations
aggagattggagctggtgaccaggggcacatgtttgggtatgcgactgacgagacccctgagctgatgcccctcagccatgtccttgccaccaagcttggtgctcgtctcacggaggttcgcaagaatggaacctgcccctggctcaggcccgatgggaagacccaggtgacagtggagtaccgcaacgagggtggcgccatggttcccatccgtgtgcacacagtcntcatctctacccagcacgacgagacagtcacca

SEQ ID NO: 158 - DNA, 288 bp, Zea mays
gcccctcagccatgtccttgccaccaagctaggtgctcgtctcaccgaggtccgcaagaacggaacctgcccctggctcaggcctgatgggaagacccaggtgacagtcgagtaccgcaatgagggtggtgccatggtccccatccgtgtccacaccgtcctcatctccacccagcacgacgagacagtgaccaatgatgagatcgctgctgacctgaaggagcatgtcatcaagcctgtcatccctgagcagtacttgacgagaagacattttccacttaaacccat

SEQ ID NO: 159 - DNA, 311 bp, Zea mays
  unsure (1)..(311): unsure at all n locations
cttctccctcttgccggtcccgaataaagagcagcagcgcaagaggtcggtagagcgagaagaaggcaatggcggccgagagcttcnttttcacntcggagtccgtgaacgaggggcaccccgacaagctgtgcgaccaggtgtcggacgccgtgcttgacgcatgcctcgcgcaggaccccgacagcaaggtggcntgcgagacntgcaccaagaccaacntggtgatggtgttcggcgagatcacgaccaaggcgaccgtggactacgagaagatcgtgcgcgacacctgccgcgagatcgggttcact

SEQ ID NO: 160 - DNA, 267 bp, Zea mays
  unsure (1)..(267): unsure at all n locations
cggacgctggngcggtggcgccttctccggcaaggaccccaccaaggtggaccgcagcggcgcctaacgtggccaggcaggccgccaagagcatcgtggccagcggcctcgcccgccgctgcctcgtgcaggtgtcgtacgccatcggctgccggagcccctgtccgtgttcgtcaactcgtacggcaccggcacgatccccgacaaggagatcctcaagatcgtgaaggagaacttcgacttcaggcccgggatgatcagcatcaa

SEQ ID NO: 161 - DNA, 284 bp, Zea mays
  unsure (1)..(284): unsure at all n locations
agctgtcgacacattcctcttcacctcggagtctgtgaacgagggacaccctgacaagctctgtgaccaggtctcagatgccgttcttgacgcttgccttgctgaggaccctgacagcaaggttgcttgtgagacctgcaccaagaccaacattcancatggtctttggtgagatcaccaccaaggccaatgttgactacgagaagattgtcagggagacctgccgcaacattggttttgtgtcaaacgatgttgggttgacgccgaccactgcaaggtgctcg

SEQ ID NO: 162 - DNA, 237 bp, Zea mays
  unsure (1)..(237): unsure at all n locations
ccatcttccacctcaacccgtccgggcgcttcgtcatcggcgggccccacggtgacgccggcctcaccggccgcaagatcatcatcgacacgtacggcggctggggagcccacggcggtggcgccttctccggcaaggaccccaccaaggtggaccgcagcggcgcctacgtggccaggcaggccgccaagagcatcgtggccagcggcctcgcccgccgctgcctcntgnaggttt

SEQ ID NO: 163 - DNA, 236 bp, Zea mays
acctgcgcctggctgaggcccgacggcaagacccaggtgacggtggagtacgtgaacgagggcggcgccatggtgcccgtccgcgtgcacaccgtgctcatctccacccagcacgacgagaccgtcaccaacgacgagatcgccgccgacctcaaggagcacgtcatcaagcccgtgatccctgagaagtacctcgacgagaagaccatcttccacctcaacccgtccgggcgctt

SEQ ID NO: 164 - DNA, 272 bp, Zea mays
  unsure (1)..(272): unsure at all n locations
ggtggacctcacggcgatgctggcctcactggccgcaagatcatcattgacacctacggtggctggggagcccatggtggtggcgctttctccggcaaggacccaaccaaggttgaccgcagcggagcctatgtcgcaaggcaggctgccaagagcatcgtcgccagcggccttgctcgccgcgccatcgtccaggtgtcttacgccatcggntggcccgagcctctctccgtgttcgtcgacacgtacggcaccggcgcgatccccgacaa

SEQ ID NO: 165 - DNA, 258 bp, Zea mays
  unsure (1)..(258): unsure at all n locations
ccaagctaggtgctcgtctcaccgaggnccgcaagaacggaacctgcccctggctcaggcctgatgggaagacccaggtgacagtcgagtaccgcaatgagggtggtgccatggtccccatccgtgtccacaccgtcctcatctccacccagcacgacgagacagtgaccaatgatgagatcgctgctgacctgaaggagcatgtcatcaagcctgtcatccctgagcagtaccttgacgagaagaccatcttccacc

SEQ ID NO: 166 - DNA, 298 bp, Zea mays
  unsure (1)..(298): unsure at all n locations
tctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcntcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgaga

SEQ ID NO: 167 - DNA, 298 bp, Zea mays
  unsure (1)..(298): unsure at all n locations
cttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcntgcgcgacacctgccgcga

SEQ ID NO: 168 - DNA, 265 bp, Zea mays
ccgaggtccgcaagaacggaacctgcccctggctcaggcctgatgggaagacccaggtgacagtcgagtaccgcaatgagggtggtgccatggtccccatccgtgtccacaccgtcctcatctccacccagcacgacgagacagtgaccaatgatgagatcgctgctgacctgaaggagcatgtcatcaagcctgtcatccctgagcagtaccttgacgagaagaccatcttccaccttaacccatctggccgtttgtcattggt

SEQ ID NO: 169 - DNA, 251 bp, Zea mays
  unsure (1)..(251): unsure at all n locations
cccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacgccgaccgctgcaaggangctggtgaacatcgagcagc

SEQ ID NO: 170 - DNA, 305 bp, Zea mays
  unsure (1)..(305): unsure at all n locations
ctcttgccggtcccgaataaagagcagcagcgcaagaggtcggtagagcgagaagaaggcaatggcggccgagancttccttttnanctcggaatncgtgaacgaggggcancccgacaagctgtgcgaccaggtgtcggacgccgtgcttgacgnatgcctcgcgcaggaccccgacagcaaggtggcctgcgagacctgcaccaagaccaacatggtgatggtgttcggcgagatcacgaccaaggcgaccgtggactacgagaagatcgtgcgcnacacctgccgcgagatcgggttcactc

SEQ ID NO: 171 - DNA, 267 bp, Zea mays
  unsure (1)..(267): unsure at all n locations
cntacggtggctggggagcccacggcgggggcgccttctccggcaaggacccgaccaaggtggaccgcagcggggcctacgtcncgnggcaggctgccaagagcatcgtcgccgccggcctcgcccgccgtgccatcgtccaggtctcctacnccatcggcgtgcccgancccctgtcggtgttcgtggacacgtacggcaccggcgcgatccccgacaaggagatcctgaagatcgtgaaggagaacttcgacttcaggcccggca

SEQ ID NO: 172 - DNA, 250 bp, Zea mays
  unsure (1)..(250): unsure at all n locations
ccaatgatgagatcgctgctgacctgaaggagcatgtcatcaagcctgtcatccctgagcagtaccttgacgagaagaccatcttccaccttaacccatctggccgctttgtcattggtggacctcacggcgatgctggcctcactggccgcaagatcatcattgacacctacggtggctggggagcccatggtggtggcgctttctccggcaaggacccaaccaaggttgaccgcagcgganctatgtc

SEQ ID NO: 173 - DNA, 304 bp, Zea mays
  unsure (1)..(304): unsure at all n locations
ctcctccctcctgccgggtccttaataaagagcagcagcgcaagangttggtagancgagcgagaagaaggcaatggcggcggagagcttcctgttcacctcggagtccgtgaacgaggggcacccagacaagctgtgcgaccaggtgtcggacgcggtgctggacgcctgcctggcgcaggaccccgacagcaaggtggcctgcgagacctgcaccaagacgaacatggtgatggtgttcggcgagatcaccaccaaggcgagcgtggactacgagaagatcgtgcgcgacacctgccgcgag

SEQ ID NO: 174 - DNA, 328 bp, Zea mays
  unsure (1)..(328): unsure at all n locations
catccgtttgcctcttctccctcttgccggtcccgaataaagagcagcagcgcaagaggtcggtagagcgagaagaaggcaatggcggccgagagcttccttttcacctcggagtccgtgaacgangggcaccccgacaagctgtgcgaaccaggtgtcggacgccgtgcttgacgcatgcctcgcgcaggaccccgacagcaangtggcctgcgagacctgcaccaagaccaacatggtgatggtgttcggcgagatcacgaccaaggcgaccgtggactacgagaagatcgtgcgcgacacctgccgcgagatcgggttcactccg

SEQ ID NO: 175 - DNA, 297 bp, Zea mays
tctccctcttgccggtcccgaataaagagcagcagcgcaagaggtcggtagagcgagaagaaggcaatggcggccgagagcttccttttcacctcggagtccgtgaacgaggggcaccccgaacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcga

SEQ ID NO: 176 - DNA, 275 bp, Zea mays
agatgccgttcttgacgcttgccttgctgaggaccctgacagcaaggttgcttgtgagacctgcaccaagaccaacatggtcatggtctttggtgagatcaccaccaaggccaatgttgactacgagaagattgtcagggagacctgccgcaacattggttttgtgtcaaacgatgttgggcttgacgccgaccactgcaaggtgctcgtgaacattgagcagcagtcccctgatatgctcagggtgtgcatggccattcaccaagcgccccgag

SEQ ID NO: 177 - DNA, 534 bp, Zea mays
  unsure (1)..(534): unsure at all n locations
gaggnagctttnannggggnttaagggnatttttaaaccctnntttgnattcccgggtcgacccacgcgtccgcttgccggtcccgaataaagagcagcnncgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacaccttnccgcgagatcgggttcacctttcgacgacntgggccttgacgcccacccggttcaaggtgcttgtgnacattgagcaagaattccccgaaattgngcaaggcgttcaccggcactttacgaaccggcccnaggaagatcggnccggccnaccanggncaattttttgggtccccccc

SEQ ID NO: 178 - DNA, 248 bp, Zea mays
gatgcccctcagccatgtccttgccaccaagcttggtgctcgtctcacggaggttcgcaagaatggaacctgcccctggctcaggcccgatgggaagacccaggtgacagtggagtaccgcaacgagggtggcgccatggttcccatccgtgtgcacacagtcctcatctctacccagcacgacgagacagtcaccaacgacgagattgctgctgacctgaaggagcacgtcatcaagccagtcatcc

SEQ ID NO: 179 - DNA, 302 bp, Zea mays
  unsure (1)..(302): unsure at all n locations
ctcctccctcctgccgggtccttaataaagagcagcagcgcaagaggttggtagagcgagcgagaagaaggcaatggcggcggagagcntcctgttcacctcggagtccgtgaacgaggggnacccagacaagctgtgcgaccaggtgtcggacgcggtgctggacgcctgcctggcgcaggaccccgacagcaaggtggcctgcgagacctgcaccaagacgaacatggtgatggtgttcggcgagatcaccaccaaggcgagcgtggactacgagaagatcgtgcgcgacacctgccgcg

SEQ ID NO: 180 - DNA, 281 bp, Zea mays
  unsure (1)..(281): unsure at all n locations
angtctcctacgccatcggcgtggcccgancccctgtcggtgttcgtggacacgtacggcaccggcgcgatccccgacaaggagatcctgaagatcgtgaaggagaacttcgacttcaggcccggcatgatcatcatcaacctcgacctcaagaaaggcggcaacgggcgctacctcaagacggcggcctacgggcactttgggagggacgaccccgacttcacctgggaaggtggtgaagcccctcaaggcggagaagccgtcttctgcatgaggcgcnt

SEQ ID NO: 181 - DNA, 269 bp, Zea mays
  unsure (1)..(269): unsure at all n locations
gacacattcctcttcacctcggagtctgtgaacgagggacaccctgnanaagctctgtgaccaggtctcagatgccgttcttgacgcttgccttgctgaggaccctgacagcaaggttgcttgtgagacctgcaccaagaccaacatggtcatggtctttggtgagatcaccaccaaggccaatgttgacgccgagaagattgtcagggagacctgccgcaacattggttttgtgtcaaacgatgttgggcttgacgcngaccatgcaa

SEQ ID NO: 182 - DNA, 286 bp, Zea mays
  unsure (1)..(286): unsure at all n locations
ccctcttgccggtcccgaataaagagcagcagcgcaagaggtcggtagagcgagaagaaggcaatggcggccgagagcttccttttcacctcggaanccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacct

SEQ ID NO: 183 - DNA, 240 bp, Zea mays
  unsure (1)..(240): unsure at all n locations
gcgcgacacctgccgcgagatcgggttcacctccgacgacgtgggcctcgacgccgaccgctgcaaggtgctggtgaacatcgagcagcagtcccccgacatcgcgcagggcgtgcacgggcacttcacgaagcggcccgaggagatcggcgcgggcgaccagggccacatgttcgggtacgncaccgacgagacccccgagctgatgccgctgagccacgtggtggccaccaagctggg

SEQ ID NO: 184 - DNA, 250 bp, Zea mays
  unsure (1)..(250): unsure at all n locations
cctgagcagtaccttgacgagaagaccatcttccaccttaacccatctggccgctttgtcattggtggacctcacggcgatgctggcctcactggccgcaagatcatcattgacacctacngtggctggggagcccatggtggtggcgctttctccggcaaggacccaaccaaggttgaccgcagcggagcctatgtcgcaaggcaggctgccaagagcatcgtcgccagcggccttgctcgccgcgcca

SEQ ID NO: 185 - DNA, 305 bp, Zea mays
gcctcttctcctccctcctgccgggtccttaataaagagcagcagcgcaagaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcaggaccccgacagcaaggtggcctgcgagacctgcaccaagacgaacatggtgatggtgttcggcgagatcaccaccaaggcgagcgtggactacgagaagatcgtgcgcgacacctgc

SEQ ID NO: 186 - DNA, 305 bp, Zea mays
  unsure (1)..(305): unsure at all n locations
cgacagcagaggnggcnngcgagacctgcaccaagaccaacatggtgatgttgttcggcgagatcacgaccaaggcgancgtggactacgagaagatcgtgcgcgacacctgatcgcgagatcgggttcacctcccgacgacgtgggcctcgacgccgaccgctgcnaggngctggtgaanatcgagcancagtcncccgacatcgcgcangcntgcacgggcacttcacnaagcgncccgangagatcgncgcggnctaccatnggcacatgttcgggtacncnaccnannagacnnncgagct

SEQ ID NO: 187 - DNA, 274 bp, Zea mays
  unsure (1)..(274): unsure at all n locations
ccttgccaccaagcttggtgctcgtctcacggaggttcgcaagantggaacctgcccctggctcaggcccgntgggaagacccaggtgacagtggagtaccgcaacgagggtggcgccatggttcccatccgtgtgcacacagtcctcatctctacccagcacgacgagacagtcancaacgacgagattgctgctgacctgaaggagcacgtcatcaagccagtcatccccgagnagnnacctcgacgagaagacaatcttccacanactnna

SEQ ID NO: 188 - DNA, 232 bp, Zea mays
agcacgtcatcaagccagtcatccccgagcagtacctcgacgagaagacaatcttccacctcaacccgtctggccgcttcgtcatcggcggacctcacggcgacgctggcctcactggccggaagatcatcatcgacacctacggtggctggggagcccacggcgggggcgccttctccggcaaggacccgaccaaggtggaccgcagcggggcctacgtcgcgaggcaggc

SEQ ID NO: 189 - DNA, 243 bp, Zea mays
gcccctcagccatgtccttgccaccaagcttggtgctcgtctcacagaggttcgcaagaatggaacctgcccctggctcaggcccgatgggaagacccaggtgacagtggagtaccgcaacgagggtggcgccatggttcccatccgtgtgcacacagtcctcatctctacccagcacgacgagacagtcaccaacgacgagattgctgctgacctgaaggagcacgtcatcaagccagtcat

SEQ ID NO: 190 - DNA, 290 bp, Zea mays
  unsure (1)..(290): unsure at all n locations
ccctcttgccggtcccgaataaagancagcagcgcaagaggtcggtagagcnagaagaangcaatggcggccgagagcttccttttcacctcggagtccgtgaacgaggggcaccccgacaagctgtgcgaccaggtgtcggacgccgtgcttgacgcatgcctcgcgcaggaccccgacancnaggtggcctgcgagacctgcaccaagaccaacatggtgatggtgttcggcnagatcacgaccaaggcgaccgtggactacnagaagatcgtgcgcgacacctgccg

SEQ ID NO: 191 - DNA, 266 bp, Zea mays
  unsure (1)..(266): unsure at all n locations
gncacattccncttcacctcggngtctgtgancgagggacaccctgacnagctctgtgaccaggtctcagatgccgttcttgacgcttgccttgctgaggancctgacagcaaggttgcttgtgagacctgcaccaagaccaacatggtcatggtctttggtgagatcaccaccaaggccaatgttgactacgagangattgtcagggagacctgccgcaacattggttttgtgtcaaacgatgttgggctgacgccgaccactgc

SEQ ID NO: 192 - DNA, 276 bp, Zea mays
  unsure (1)..(276): unsure at all n locations
gtgccatggtccccatccgtgtccacaccgtcctcatctccacccagcacgacgagacagtgaccaatgatgagatcgctgctganctgaaggagcatgtcatcaagcctgtcatccctgagcagtaccttgacgagaagaccatcttccacttaacccatctgcccgctttgtcattggtggacctcacggcgatgctggcctcactggccgcaagatcatcattgacactacggtggctggggagccnatgntgtggcgtttncngggaaggcc

SEQ ID NO: 193 - DNA, 292 bp, Zea mays
  unsure (1)..(292): unsure at all n locations
anggtggctggggagcccatggtggtggcgctttctccggcaaggacccaaccaaggttgacngcagcggagcctatgtncgcaaggcaggctgccaagagcatcgtcgccagcggccttgctcgccgcgccatcgtccaggtgtcttacgccatcggcgtgcccgagcctctctccgtgttcgtcgacacgtacggcaccggcgcgatccccgacaaggagatcctcaagattgtcaaggagaattcgatttcaggcctggcatgatctcatcaaccttgactcaagaagg

SEQ ID NO: 194 - DNA, 226 bp, Zea mays
  unsure (1)..(226): unsure at all n locations
ctacgagaagatcgtgcgcgacacctgccgcgagatcgggttcacctccgacgacgtgggcctcgacgccgaccgctgcaaggtgctggtgaacatcgagcagcagtcccccgacatcgcgcagggcgtgcacgggcacttcacgaagcggcccgaggagatcggcgcgggcgaccagggccacatgttcgggtacgccaccgacgagacncccgagctgatgcng

SEQ ID NO: 195 - DNA, 289 bp, Zea mays
  unsure (1)..(289): unsure at all n locations
cttcnccctcttgccggtcccgaataaagagcagcagcgcaagaggncggtagagcgagaagaaggcaatggcggccgagagcttccttttcacctcggagtccgtgaacgaggggcaccccgacaagctgtgcgaccaggtgtcggacgccgtgcttgacgcatgcctcgngcaggaccccgacagcaaggtggcctgcgagacctgcaccaagaccaacatggtgattgtgttcggcgagatcacgaccanggcgaccgtggactacgagaagatcgtgcgcnacac

SEQ ID NO: 196 - DNA, 300 bp, Zea mays
  unsure (1)..(300): unsure at all n locations
cgcctcttctcctccctcctgccgggtccttaataaagagcagcagcgcaagnggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcaggaccccgacagcaaggtggcctgcgagacctgcaccaagacgaacatggtgatggtgttcggcgagatcaccaccaaggcgagcgtggactacgagaagatcgtgcgcgac

SEQ ID NO: 197 - DNA, 284 bp, Zea mays
  unsure (1)..(284): unsure at all n locations
ccctcttgncggtcccgaataaagagcagcagcgcaagaggtcgntagagcgagaagaaggcaatggcggccgagagcttccttttcacctcggagtccgtgaacgaggggcaccccgacaagctgtgcgaccaggtgtcggacgccgtncttgangcatgcctcgcgcaggaccccgacagcaaggtggcctgcgagacctgnaccaagacnaacatggtgatggtgttcggcgagatcacgaccaaggcgaccgtggactacgagaagatcgtgcgcgacac

SEQ ID NO: 198 - DNA, 282 bp, Zea mays
  unsure (1)..(282): unsure at all n locations
gtcccgaataaagagcagcagcgcaagangtcggtagagcganaanaangcaatggcggcnaagagcttccttttcacctcggagtccgtgaacgaggggcancccgaacaagctgtncgaccaggtgtcggacgccgtgcttgacgcatgcctcgcgcaggaccccgacagcaaggtggcctgcgagacctgcaccaagaccaacatngtgatggtgttcggcgagatcacgaccaangcgaccgtggactacgagaagatcgtgcgcgacacctgccgcg

SEQ ID NO: 199 - DNA, 292 bp, Zea mays
  unsure (1)..(292): unsure at all n locations
acgccatcggntgccggancccctgtccgtgttcgtcaactcgtacggcaccggcacgatccccgacaaggagatcctcaagatcgtgaaggagaacttcgacttcaggcccgggatgatcagcatcaacctcgacctgaagaagggcggcaacaggttcatcaagaccgncgcctacggccacttcggccgtgacgacgccgacttcacctgggaggtggtgaagcccctcaagttcgacaaggcatcggcttaaggttgggantgtcatgtggacatgangatacntcct

SEQ ID NO: 200 - DNA, 291 bp, Zea mays
  unsure (1)..(291): unsure at all n locations
cgtttgcctcttctccctcttgccggtcccgaataaagagcagcagcgcaagaggtcggtagagcgagaagaaggcaatggcggccgagagcttccttttcacctcggagtccgtgaacgangggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgg

SEQ ID NO: 201 - DNA, 337 bp, Zea mays
  unsure (1)..(337): unsure at all n locations
gtnttacgcnatcngcaggcccnagnntctctncgtgttcgtcgacacgtanggcancggcgngatnncnganaaggagatcctcaagattgtnaaggngaactnngatttcaggcctggcatgatcatcatcaaccttgacctcaaganaggcggnaacgggcgctacctcaagacggcggattanggccactttggaagggangaccctgacttcacctgggatgtggtnaagccactcaantcggagaaacctnctgcctaaggcggntttnttttcagtaagaagcttttggtggtctgctgtgcttaatcatgcnttatatggcttctacac

SEQ ID NO: 202 - DNA, 279 bp, Zea mays
cttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcg

SEQ ID NO: 203 - DNA, 443 bp, Zea mays
  unsure (1)..(443): unsure at all n locations
aaantcacgggtcgacncacgcgtcnnnacngactnntactaacgcgtgggcggacgcgtggggganggtgtggacacggntggggaccatggcagcaccctcattgcggtaatcgactgtcacccctgagcagtaccttgacgagaagaccatcttccaccttaacccatctggccgctttgtcattggtggacctcacggcgatgctggcctcactggccgcaagatcatcattgacacctacggtggctggggagcccatggtggtggcgctttctccggcaaggacccaaccaaggttgaccgcagcggagcctatgtcgcaaggcangctgcnaagagcatcgtcgccagcgggccttgctcgnccgngccatcgtccaaggtgtncttaagccaatcggcntgcccgancctntctccgnttttcgtcnaaangtta

SEQ ID NO: 204 - DNA, 290 bp, Zea mays
  unsure (1)..(290): unsure at all n locations
tgcctcttctccctcttgccggtcccgaataaagagcagcagcgcaagaggtcggtagagcgagaagaaggcaatggcggccgagagcttccttttcacctcggagtccgtgaacgangggcaccccgacaagctgtgcgaccaggtgtcggacgccgtgcttgacgcatgcctcgcgcaggancccgacagcaaggtggcctgcgagacctgcaccaagaccaacatggtgatggtgttcggcgagatcacgaccaaggcgaccgtggactacgagaagatcgtgcgcg

SEQ ID NO: 205 - DNA, 304 bp, Zea mays
  unsure (1)..(304): unsure at all n locations
cgcctcntcnccncccnccngccgggtccttaataaagagcagcagcgcaagangttggtagagcgagcgagaaagaaggcatggcggcggagagcttcctgttcacntcggagtccgtgaacgaggggcacccagacaagctgtgcgaccaggtgtcggacgcggtgctggacncctgcctggcgcaggaccccgacagcaaggtggcctgcgagaccngcaccaagacgaacatggtgatggtgttcggcgagatcaccaccaaggcgagcgtggacnacgagaagatcgtgcgcgacacct

SEQ ID NO: 206 - DNA, 290 bp, Zea mays
  unsure (1)..(290): unsure at all n locations
ctcttctcctccctcctgccgtttccttaataaagagcagcagcgcaagaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcaggaccccgacagcaaggtggcctgcgagacctgcaccaagacgaacatggtgatggtgttcggcgagatcaccaccaaggcgagcgtngactacgagaagatcgt

SEQ ID NO: 207 - DNA, 247 bp, Zea mays
  unsure (1)..(247): unsure at all n locations
gatcaccaccaaggccaatgttgactacgagaagattgtcagggagacctgccgcaacattggttttgtgtcaaacgatgttgggcttgacgccgaccactgcaaggtgctcgtgaacattgagcagcagtcccctgatattgctcagggtgtgcatggccacttcaccaagcgccccgaggagattggagctggtgaccagngacacatgttcgggtatgcgaccgatgagaccctgagttgatgc

SEQ ID NO: 208 - DNA, 291 bp, Zea mays
  unsure (1)..(291): unsure at all n locations
cgtttgcctcttctccctcttgccggtcccgaataaagagcagcagcgcaagaggtcggtagagcgagaagaaggcaatggcggccgagagcttcnttttcacctcggagtccgtgaacgaggggcaccccgacaagctgtgcgaccaggtgtcggacgccgtgcttgacgcatgcctcgcgcaggaccccganagcaaggtggcctgcgagacctgcaccaagaccaacatggtgatggtgttcggcgagatcacgaccaaggcgaccgtggactacgagaagatcgtgc

SEQ ID NO: 209 - DNA, 428 bp, Zea mays
  unsure (1)..(428): unsure at all n locations
cggacgcttgggctttcgcgtggggtcgacacgtacgggnccggggggatcnccgacaaggagatcctcaagattgtcaaggagaacttttatttcaggcctggcatgatcatcatcaaccttgacctcaagaaaggcggcaacgggcgctacctcaagacggcggnctacggccactttggaagggacgaccctgacttcacctgggaggtggtgaagccactcaagtcggagaaaccttctgcctaaggcggccttttttttcagtaagaagcttttggtggtctngctgtgcttaatcatgcttttatatggcttctacatgttggaggntctttcttgatctgcaccgggcttatcgnttgtgttgnactgccctaataagtggtgcttatgaggactggttctggttttgctgcttatgtngt

SEQ ID NO: 210 - DNA, 295 bp, Zea mays
  unsure (1)..(295): unsure at all n locations
ccttaatnaagngcagcagcgcaaggtgagccgccagcttgccccaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcaggaccccgacagcaaggtggcctgcgagacctgcaccaagacgaacatggtgatggtgttcggngagatcaccaccaaggcgagcgtggactacgagangntcgtgcncgacac

SEQ ID NO: 211 - DNA, 257 bp, Zea mays
  unsure (1)..(257): unsure at all n locations
ggccacttcancaagcgtcccgaggagattggagctggtgaccagggacncgtgttgcgggtatgcgaccgatgagacccctgagttgntgcccctcagccatgtccttgccaccaagctaggtgctcgtctcactgaggtccgcaagaacggaacctgcccctggctcaggcctgatgggaagacccnngtgacagtcgagtaccgcaatgagggtggtgcnatggtcccngnnngtgtccanaccgtcctcattt

SEQ ID NO: 212 - DNA, 288 bp, Zea mays
ctcggatccgcccgaccacgaccaccccgcgtcgccgccgcgcagaagcagcagatcagagaagatggccggactcgacaccttcctcttcacctcggagtccgtgaacgagggacaccctgacaagctctgcgaccaggtctcagatgctgttctggacgcttgccttgctgaggaccctgacagcaaggttgcttgcgagacctgcaccaagaccaacatggtcatggtctttggtgagatcaccaccaaggcaatgtcgactagagaagattgtcagggagacat

SEQ ID NO: 213 - DNA, 467 bp, Zea mays
  unsure (1)..(467): unsure at all n locations
ttnnnnttccttnggccccnaaaggtaaaaggactcccgggtcgacccacgcgtcagccacgcgtccgcccacgcgtccgcccacgcgtccgcccacgcgtccgcccacgcgtccgccccctcctgccgggtccttaataaagagcagcagcgcaaggtgagccgccagcttgccccggttggtagagcgagcganaagaangcaatggcggcgganagcttcctgttcacctcgggtccgtgaacgaggggcacccagacaagctgtgcgaccaggtgtcggacgcggtgctggcgcctgcctggcgcaggaccccgacagcaaggtggcctgcgagacctgcaccaagacgacatggtgatggtgttcggcgagatnaccaccaaggcgagcgtggactacgaaaaagatntgcgcgaaaactggccgccaagatcgggttcacctccgacgacgtggggctcga

SEQ ID NO: 214 - DNA, 287 bp, Zea mays
cggacctgggcgttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgatcgtggactacgagaaga

SEQ ID NO: 215 - DNA, 294 bp, Zea mays
  unsure (1)..(294): unsure at all n locations
ctcttctcctccctcctgnngggtccttaataaagagcagcagcgcaagangttggtagagcgancganaagaaggcaatggcggcggagagcttcctgttcanctcggagtccgtgaacgaggggcacccagacaagctgtgcgaccaggtgtcggacgcggtgctggacgcctgcctggcgcaggaccccgacagcaaggtggcctgcgagacctgcaccaagacgaacatggtgatggtgttcggcgagatcaccaccaaggcgagcgtggactacnagaagatcgtgcgc

SEQ ID NO: 216 - DNA, 228 bp, Zea mays
cggaacctgcccctggctcaggcctgatgggaagacccaggtgacagtcgagtaccgcaatgagggtggtgccatggtccccatccgtgtccacaccgtcctcatctccacccagcacgacgagacagtgaccaatgatgagatcgctgctgacctgaaggagcatgtcatcaagcctgtcatccctgagcagtaccttgacgagaagaccatcttccaccttaaccc

SEQ ID NO: 217 - DNA, 268 bp, Zea mays
  unsure (1)..(268): unsure at all n locations
cggcccacttcaccaagcgcccantaggagattggagctngtgaccaggggcacatgtangggtatgcgactgacgagacccctgagctgatgcccctcagccatgtccttgccaccaagcttggtgctcgtccacggaggttcgcaagaatggaacctgcccctggctcaggcccgatgggaagacccaggtgacagtggagtaccgcaagagggtggcgccatggttcccatccgtgtgcacacagtcctcatctctacccagcag

SEQ ID NO: 218 - DNA, 263 bp, Zea mays
  unsure (1)..(263): unsure at all n locations
cgcatgcctcgcgcagcaccccgacagcaaggtggcntgcgagacctgcaccaagaccaacatggtnatggtnttcggcgagatcacgaccaaggctaccgtgggactacgagaagatcgtgcgctacacctgncgcgagatcnggttcacctccgacgacgtgggcctcgacgcctaccgctncaaggtgctggtgaacatctagcagcagtcccccgacatnncgcagggcgtgcacgggcattcnngaagcggcccgagg

SEQ ID NO: 219 - DNA, 256 bp, Zea mays
  unsure (1)..(256): unsure at all n locations
gagcccacggcgggggcgccttctccggcaaggacccgaccaaggtggaccgcagcggggcctacgtcgcgaggcaggctgccaagagcatcgtcgccgccggcctcgcccgccgcgccattgtccaggtctcctacgccatcgggtgcccgancccctttcggtgttcgtggacacgtacggcaccggcgcgatccccgacaaggagatcctgaagatcgtgaaggagaattcgacttcaggcccggcatgatca

SEQ ID NO: 220 - DNA, 334 bp, Zea mays
  unsure (1)..(334): unsure at all n locations
anngccggagcccctgtccgtgttcgtcaactcgtacggcaccggcacgatccccgacaaggagatcctcaagatcgtgaaggagaacttcgacttcaggcccgggatgatcagcatcaacctcgacctgaagaagggcggcaacaggttcatcaagaccgccgcctacggccattcggccgtgacgacgccgacttcacctgggaggtggtgaagcccctcaagttcgacaaggcatcggcttaaggttnggatgtcactgtggacatgaggactacttcctctggctctgctgttacctgcaagcattgtgctgtggatgtgtgtgtttgat

SEQ ID NO: 221 - DNA, 255 bp, Zea mays
  unsure (1)..(255): unsure at all n locations
ccccgacaagctgtgcgaccaggtgtcggacgccgtgcttgacgnatgcntcncgcaggnccccnncancnnggtggcctgcgagacctgcaccaagaccaacatngtgatggtgttcggcgagatcacgancaaggcgaccgtggactacgagnngatcgtncgcgacacctgccgcgagatcgggttcaatccgangangtgggcctcnacgccgnncgctgcnaggtgctggtgaacntcgagcagcagtcc

SEQ ID NO: 222 - DNA, 222 bp, Zea mays
ccacccagcacgacgagacagtgaccaatgatgagatcgctgctgacctgaaggagcatgtcatcaagcctgtcatccctgagcagtaccttgacgagaagaccatcttccaccttaacccatctggccgctttgtcattggtggacctcacggcgatgctggcctcactggccgcaagatcatcattgacacctacggtggctggggagcccatggtggtg

SEQ ID NO: 223 - DNA, 269 bp, Zea mays
ctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgag

SEQ ID NO: 224 - DNA, 311 bp, Zea mays
  unsure (1)..(311): unsure at all n locations
ccccgttcgcctcttctcctccctcctgccgggtccttaataaagagcagcagcgcaagaggttgggagagcgagcgagaagaaggcaatggcggcggagagcttcctgttcacctctgagtccgtgaacgangggcanccagacaagctgtgcgaccaggtgtcggacgctgtgctggactcctgcctggcgcaggaccccgacagcaaagtggcctgcgagacctgcaccaagacgaacatggtgatggtgttcggcgagatcancancaangcgagcgtggactacgagaagatngtgcgcgacacct

SEQ ID NO: 225 - DNA, 293 bp, Zea mays
gtgttcgtcaactcgtacggcaccggcacgatccccgacaaggagatcctcaagatcgtgaaggagaacttcgacttcaggcccgggatgatcagcatcaacctcgacctgaagaagggcggcaacaggttcatcaagaccgccgcctacggccacttcggccgtgacgacgccgacttcacctgggaggtggtgaagcccctcaagttcgacaaggcatcggcttaaggttgggagtgtcactgtggacatgaggactaccttcctctggctctgctgttacctgcaagcat

SEQ ID NO: 226 - DNA, 225 bp, Zea mays
gccggagcccctgtccgtgttcgtcaactcgtacggcaccggcacgatccccgacaaggagatcctcaagatcgtgaaggagaacttcgacttcaggcccgggatgatcagcatcaacctcgacctgaagaagggcggcaacaggttcatcaagaccgccgcctacggccacttcggccgtgacgacgccgacttcacctgggaggtggtgaagcccctcaagtt

SEQ ID NO: 227 - DNA, 256 bp, Zea mays
  unsure (1)..(256): unsure at all n locations
cacctcaacccgtctggccgcttcgtcatcggcggacctcacggcgacgctggcctcactggccggaagatcatcatcgacacctacggtggctggggagcccacggcgggggcgccttctccggcaaggacccgaccaaggtggaccgcagcggggcctacgtcgcgaggcaggctgccaagagcatcgtcgccgccggcctcgcccgcngtgccatcgtcaagtnttcnaaggcatcgggttgcccgaanccct

SEQ ID NO: 228 - DNA, 281 bp, Zea mays
  unsure (1)..(281): unsure at all n locations
tcatcattgacacctacngtggctggggagcccatggtggtggcgctttctccggcaaganacccaaccaaggttgaccgcagcggagcctatgtcgcaaggcaggctgccaagagcatcgtcgccagcggccttgctcgccgcgccatcgtccaggtgtcttacgccatcggntgcccgagcctctctccgtgttcgtcgacacgtacggcaccggcgcgatccccgacaaggagatctcaagattgtcaaggagaattcgatttcaggctggcatgatc

SEQ ID NO: 229 - DNA, 290 bp, Zea mays
ctccgcctcgaccggatctcgtcggactcggatccgcccgaccaccccgcgccgccgcagatccagagaagatggcagctgtcgacacattcctcttcacctcggagtctgtgaacgagggacaccctgacaagctctgtgaccaggtctcagatccgttcttgacgcttgccttgctgaggaccctgacagcaaggttgcttgtgagacctgcaccaagaccaacatggtcatggtctttggtgagatcaccaccaaggccaatgttgactacgagaagattgtcaggg

SEQ ID NO: 230 - DNA, 318 bp, Zea mays
  unsure (1)..(318): unsure at all n locations
ctntctccctctttgccggtcccgaataaagagcagcagcgcaagaggtcggtagagcgagaagaaggcaatggcggccgagagcttccttttcacctcggagtccgtgaaacgaggggcaccccgaacaagctgtgcgaccangtgtcggacgccgtgctttgacgcatgnctcncgcangagnccgacagcaangtggcctgcgagacctgcaccaagancaacatggtgatggtgttcggcgagatcacgaccaaggcgaccgtggactacgagaagatcgtgcgcgacacctgccgcgagatcgggttcactcc

SEQ ID NO: 231 - DNA, 276 bp, Zea mays
  unsure (1)..(276): unsure at all n locations
attgacacctacggtggctggggagcccatggtggtggcgctttctccggcaaggacccaaccaaggttgaccgcagcggagcctatgtcgcaaggcaggctgccaagagcatcgtcgccagcggccttgctcgccgcgccatcgtccaggtgtcttacgccatcggntgcccgagcctctctccgtgttcgtcgacacgtacggcaccggcgcgatccccgacaaggagatcctcaagatgtcaaggagaattcgatttcangctggcatgatca

SEQ ID NO: 232 - DNA, 244 bp, Zea mays
ctcacggcgatgctggcctcactggccgcaagatcatcattgacacctacggtggctggggagcccatggtggtggcgctttctccggcaaggacccaaccaaggttgaccgcagcggagcctatgtcgcaaggcaggctgccaagagcatcgtcgccagcggccttgctcgccgcgccatcgtccaggtgtcttacgccatcgggtgcccgagcctctctccgtgttcgtcgacacgtacggc

SEQ ID NO: 233 - DNA, 349 bp, Zea mays
  unsure (1)..(349): unsure at all n locations
atcaccaccaagggccaatgttgactacgagaagattgtcagggagacctgccgcaacattggtttgtgtcaaaacgatgttgggcttgacgccgaccactgcaaggtgctcgtgaacattgagcagcagtcccctgatattgctcagggtgtgcatggccacttcaccaagcgccccgaggagattggagctggtgaccagggacacatgttcgggtatgcgaccgatgagaccctgagttgatgccctcaagccatgtcttgccaccagctagtgctcgtctcacgaggccgcaaaanggactgnccnggnnaanctgatggagaccagtganatcgagtacncatt

SEQ ID NO: 234 - DNA, 228 bp, Zea mays
cggcgatgctggcctcactggccgcaagatcatcattgacacctacggtggctggggagcccatggtggtggcgctttctccggcaaggacccaaccaaggttgaccgcagcggagcctatgtcgcaaggcaggctgccaagagcatcgtcgccagcggccttgctcgccgcgccatcgtccaggtgtcttacgccatcggcgtgcccgagcctctctccgtgttcgt

SEQ ID NO: 235 - DNA, 263 bp, Zea mays
  unsure (1)..(263): unsure at all n locations
cctgacagcaaggttgcttgcgagacctgcaccaagaccaacatggtcatggtctttggtgagatcaccaccaaggccaatgtcgactacgagaagattgtcagggagacatgccgcaacatncgtttcgtgtcgaacgatgtcgggcttgacgctgaccactgcaaggtgcttgtnaacattnagcagcagtcccctgatattgctcagggtgtgcaggccattcacnaagccccccgaggagntngagtgtgaccagggga

SEQ ID NO: 236 - DNA, 219 bp, Zea mays
  unsure (1)..(219): unsure at all n locations
gcgagaagaaggcaatggcggccgagagcttccttttcacctcggagtccgtgaacgaggggcancccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgaga

SEQ ID NO: 237 - DNA, 301 bp, Zea mays
  unsure (1)..(301): unsure at all n locations
cgttcgcctcttctcctccctcctgccgggtccttaataaagagcagcagcgcaagaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcaggaccccgacagcaaggtggcctgcgagacctgcaccaagacgaacatggtgatggtgttcggcgagatnaacaacaaaggcgagcgtggactacgagaagatggtgcg

SEQ ID NO: 238 - DNA, 439 bp, Zea mays
  unsure (1)..(439): unsure at all n locations
gtcggatctgagacgagacgagttaccatctcatcccaactccggaacgaacaagttaccatctcatcccaactccgcctcgaccggatctcgtcggactcggatccgcccgaccaccccgcgccgccgcagatcaaagaagatggcagctgtcgacacattcctcttcacctcggagtctgtgaacgagggacaccctgacaagctctgtgaccaggtctcagatgccgttcttgacgcttgccttgctgaggaccctgacagcaaggttgcttgtgagacctgcaccaagaccaacatgggcatggnctttggtgagatcaccaccaaggccaatggtgactaccaagaagattgtcagggagnacctgccgnaacattnggtttggggtcaaacgatgttggcttgacgccaaccactggaaggggctcgtnaant

SEQ ID NO: 239 - DNA, 239 bp, Zea mays
  unsure (1)..(239): unsure at all n locations
aggtgacagtcgagtaccgcaatgagggtggtgccatggtccccatccgtgtccacaccgtcctcatctccacccagcacgacgagacagtgaccaatgatgagatcgctgctgacctgaaggagcatgtcatcaagcctgtcatccctgagcagtaccttgacgagaagaccatcttccaccttaacccatctggccgcnttgtcattggtggactcacggcgatgtggcctcactgg

SEQ ID NO: 240 - DNA, 224 bp, Zea mays
  unsure (1)..(224): unsure at all n locations
gtcagggagacatgccgcaacattggtttcgtgtcgaacgatgtcgggcttgacgctgaccactgcaaggtgcttgtgaacattgagcagcagtcccctgatattgctcagggtgtgcacggccacttcaccaagcgccccgaggagattggagctggtgaccaggggcacatgtttnggtatncnanttacnngacacctgagctgatgcccctcagccatgt

SEQ ID NO: 241 - DNA, 274 bp, Zea mays
ctcggatccgcccgaccacgaccaccccgcgccgccgccgcgcagagcagcagatcagagaagatggccggactcgacaccttcctcttcacctcggagtccgtgaacgagggacaccctgacaagctctgcgaccaggtctcagatgctgttctggacgcttgccttgctgaggaccctgacagcaaggttgcttgcgagacctgcaccaagaccaacatggtcatggtctttggtgagatcaccaccaaggccaatgtcgatacgagaagat

SEQ ID NO: 242 - DNA, 232 bp, Zea mays
  unsure (1)..(232): unsure at all n locations
ccctgacaagctctncgaccaggnctcanatgctgttctggacgcttgccttgctgaggaccctgacagcaaggttgcttgcnagacntgcaccaagaccaacatggncanggtctttggtgagatcaccaccaaggccaangtcgactacgaggagattgtcagggagacatgccgcaacattggtntcgtgtcgaacgatgtcgggcttgacgctgaccactgcaaggtg

SEQ ID NO: 243 - DNA, 267 bp, Zea mays
  unsure (1)..(267): unsure at all n locations
cntctccctcttgccggtcccgantaaagagcagcagcgcaagaggtcggtagagcgagaagaaggcaatggcggccgagagcntccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggact

SEQ ID NO: 244 - DNA, 309 bp, Zea mays
  unsure (1)..(309): unsure at all n locations
cgcctcntcnccncccnccngccgggtccttaataaagagcagcagcgcaaggtgagccgccagcttgccccaggttggtagagcgagcgagaagaaggcaatggcggcggagagcttcctgttcacatcggagtccgtgaacgaggggcacccagacaagctgtgcgaccaggtgtcggacgcggtgctggacgcctgcntggcgcaggaccccgacagcaaggtggcctgcgagaccngcaccaagacgaacatggtgatggtgttcggcgagatcaccaccaaggcgagcgtggacaacgagaaga

SEQ ID NO: 245 - DNA, 347 bp, Zea mays
  unsure (1)..(347): unsure at all n locations
cgcctcgaccgggatctcgtcggactcggatccgcccgaccaccccgcgccgccgcagatcaaagaagatggcagctgtcgacacattcctcttcacctcggagtctgtgaacgagggacaccctgacaagctctgtgaccaggtctcagatgccgttcttgacgcttgccttgctgaggaccctgacagcaaggttgcttgtgagacctgnaccaagaccaacatggtcatggtctttggtgagatcaccaccaaggccattgtgactacgagaagattgtccagggagacttgccgcaacattggtttgtgtcaaacgatgttgggntgacgccacactgcaaag

SEQ ID NO: 246 - DNA, 261 bp, Zea mays
  unsure (1)..(261): unsure at all n locations
cggacggtgggcggangcgtgggcggacgcgtggggtttcgtgtcgaacgatgtcgggcttgangctgaccactgcaaggtgcttgtgaacattgnnncagcagtcccctnatattgctcagngtgtgcacggccacttcaccaagcgccccgaggagattggagctggtgaccaggggcacatgtttgggtatgcnactgacgagacccctgagctgatgcccctcagccatgtccttgccaccaagcttggtgctcgtc

SEQ ID NO: 247 - DNA, 211 bp, Zea mays
gcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggctcgacgccgaccgctgc

SEQ ID NO: 248 - DNA, 301 bp, Zea mays
  unsure (1)..(301): unsure at all n locations
gccatcggcgtgccggancccctgtccgtgtncgtcgactccnacggcaccgggaccatccccgacaaggaganncgggnganngtcaaggagaacttcgacttcaggccagggatgatcaccatcaacctcgacctcaagaagggcggcaacaggttcatcaagaccgccgcatacggccactttggccgtgacgacgccgacttcacctgggaggnggtcaagcccctaaagaaggcatccgcttaagaatgtattgggaagttcactggacatgaggttcatcttcgtctggctctgc

SEQ ID NO: 249 - DNA, 320 bp, Zea mays
caccggcgcgatccccgacaaggagatcctgaagatcgtgaaggagaacttcgacttcaggcccggcatgatcatcatcaacctcgacctcaagaaaggcggcaacgggcgctacctcaagacggcggcctacgggcactttgggagggacgaccccgacttcacctgggaggtggtgaagcccctcaaggcggagaagccgtcttctgcatgaggcgcctcctctgttttggaagaagcttttggtctggtctggtctggtctggtgtgcctgcgctctatcatgcttttttatggctcctacttgtgattcttgatct

SEQ ID NO: 250 - DNA, 282 bp, Zea mays
  unsure (1)..(282): unsure at all n locations
acttcacgaagcggcccgaggagatcggcgcgggcgaccangncncacatgttcgggtacgccaccgacgagacccccgagctgatgccgctgagccacgtgctggccancaagctgggcgcgcgctcaccgagncacgcaagaacggcactgcgcgtggctnaggccncgacggcaagacccaggtgacggtggagtacgtgaacgatggcggcgccatggtgcccgtccgcgtgcacacgtgctcatctncacccagcacgacgannactnaacaacgac

SEQ ID NO: 251 - DNA, 239 bp, Zea mays
  unsure (1)..(239): unsure at all n locations
cttccacctcaacccgtctggccgcttcgtcatcggcggacctcacggcgacgctggcctcactggccggaagatcatantccaggtctcctacgccatcggcgtgcccgaaacccctgtcggtgttcgtggacacgtacggcaccggcgcgatccccgacaaggagatcctgaagatcgtgaaggagaacttcgacttcaggcccggcatgatcatcatcaacctcgacctcaagaaa

SEQ ID NO: 252 - DNA, 511 bp, Zea mays
  unsure (1)..(511): unsure at all n locations
gnnnnnnngaaaantctacccngtcaggtgccggtcangagaattcacgggncgacccagcgtccaccacggnggtggcgccttctccggcaaggaccccaccaaggtggaccgcagcgcgcctacgtggccaggcaggccgccaagagcatcgtggccagcggcctcgcccgccgcgcctcgtgcaggtgtcgtacgccatcggcgtgccggagcccctgtccgtgttcgtcaaccgtacggcaacggcacgattcccgacaagggagattctcaaagatcgttaaggagaaactcgaacttnaanggccgggaanattaagcaatcaaacctncgaacctngaaaaaagggcggcaacaaggttnaatcaaaaancgcccgcctaaggncaattnggcccgttaaccaacgcganttcaactgggaagtggtnaaacccctcaaattccacaaagcatcggcttaaaggttggaatttcactgtggacattaaggactaancttcctct

SEQ ID NO: 253 - DNA, 234 bp, Zea mays
  unsure (1)..(234): unsure at all n locations
cnacgngtcngaatgagcacgtcancaagcccgtcatcccggagaggtacctggacgagaagacnatctnccnncnnnnnncgtcnnggcgcttcgtcatcggcgggccccacggggacgccggcctcaccggccgcaagatcatcatcgacacctacggcggctggggagcccacggcgggggcgccttctccggcaaggaccccaccaangtggaccgcngcggggcctact

SEQ ID NO: 254 - DNA, 295 bp, Zea mays
  unsure (1)..(295): unsure at all n locations
ctcttctcctccctcctgncgggtccttaataaagagcagcagcgcaaggtgagccgccagcttgccccaggttggtagagcgagcgagaagaaggcaatggcggcggagagcttcctgttcacgtcggagtccgtgaacgaggggcacccagacaagctgtgcgaccaggtgtcggacgcggtgctggacgcctgcctggcgcaggaccccgacagcaaggtggcctgcgagacctgcaccaagacgaacatggtgatggtgttcggcgagatcaccaccaaggcgagcgtgga

SEQ ID NO: 255 - DNA, 257 bp, Zea mays
  unsure (1)..(257): unsure at all n locations
ccaangangagancgcngcngacctgaaggagcatgtcancaagcctgtcanccctgagcagnacctngacgagaagaccancttccacctnaacccancnggccgctntgtcattggtggaccncacggcgatgcnggcctcacnggccgcaagancancatngacaccnacggtggcnggggagcccatggtggtggcgcntncnccggcaaggacccaaccaaggttgaccgcagcggacctatgtcgcaaggc

SEQ ID NO: 256 - DNA, 206 bp, Zea mays
ggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcagcagtcccccgacatcgcgcagggcgtgcacgggcacttcacgaagcggcccgaggagatcggcgcgggcgacca

SEQ ID NO: 257 - DNA, 208 bp, Zea mays
agacaatcttccacctcaacccgtctggccgcttcgtcatcggcggacctcacggcgacgctggcctcactggccggaagatcatcatcgacacctacggtggctggggagcccacggcgggggcgccttctccggcaaggacccgaccaaggtggaccgcagcggggcctacgtcgcgaggcaggctgccaagagcatcgtcgccgc

SEQ ID NO: 258 - DNA, 339 bp, Zea mays
  unsure (1)..(339): unsure at all n locations
aacgagggtggcgccatggttcccatccgtgtgcacacagtcctcatctctacccagcacgacgagacagtcaccaacgacgagattgctgctgacctgaaggagcacgtcatcaagccagtcatccccgagcagtacctcgacgagaagacaatcttccacctcaacccgtctggccgttcgtcatcggcggacctcacggcgacgcggcctcactggcggaagatcatcatcgacacctacggtgnttgggagccacggcggggcgctttncggcaaggaccgncaagtggacgancggggctagtcngagcagntgcaaganatgtcgcgcggctg

SEQ ID NO: 259 - DNA, 195 bp, Zea mays
caggaccccgacagcaaggtggcctgcgagacctgcaccaagaccaacatggtgatggtgttcggcgagatcacgaccaaggcgaccgtggactacgagaagatcgtgcgcgacacctgccgcgagatcgggttcacctccgacgacgtgggcctcgacgccgaccgctgcaaggtgctggtgaacatcgagcag

SEQ ID NO: 260 - DNA, 267 bp, Zea mays
  unsure (1)..(267): unsure at all n locations
cgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcganatcacgaccaaggcga

SEQ ID NO: 261 - DNA, 272 bp, Zea mays
  unsure (1)..(272): unsure at all n locations
atccgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatngtgttcggcgagatcacgaccaangcgacc

SEQ ID NO: 262 - DNA, 335 bp, Zea mays
  unsure (1)..(335): unsure at all n locations
gcggactaatgtcgcaaggcaggctgccaagagcatcgtcgccagcggccttgctcgccgcgccatcgtccaggtgtcttacgccatcgggtgcccgagcctctctccgtgttcgtcgacacgtacggcaccggcgcgatccccgacaaggagatcctcaagattgtcaaggagaactcgatttcaggcctggcatgatcatcatcaaccttgacctcaagaaaggcggcaacgggcgctactcaagagngcggctacggccactttggaagggacgacctgattcacctgggaggtggtgaagccattcaatcggagaaactttgctaagcggc

SEQ ID NO: 263 - DNA, 270 bp, Zea mays
  unsure (1)..(270): unsure at all n locations
cacacatccgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcntcgcgcaggaccccgacagcaaggtggcctgcgagacctgcaccaagaccaacatggtgatggtgttcggcgagatcacgaccaa

SEQ ID NO: 264 - DNA, 246 bp, Zea mays
gatctcgtcggactcggatccgcccgaccaccccgcgccgccgcagatcaaagaagatggcagctgtcgacacattcctcttcacctcggagtctgtgaacgagggacaccctgacaagctctgtgaccaggtctcagatgccgttcttgacgcttgccttgctgaggaccctgacagcaaggttgcttgtgagacctgcacaaagacaaacatggtcatggtctttggtgagatcaccaccaagg

SEQ ID NO: 265 - DNA, 263 bp, Zea mays
  unsure (1)..(263): unsure at all n locations
ctcttctccctcttgccgntcccgaataaagagcagcagcgcaagaggtcggtagagcgagaagaaggcaatggcggccgagagcttccttttcacntcggagtccgtgaaanangggcacnccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccg

SEQ ID NO: 266 - DNA, 295 bp, Zea mays
  unsure (1)..(295): unsure at all n locations
cgcctcgaccggatctcgtcggactcggatccgcccgaccaccccgcgccgccgcagatcaaagaagatggcagctgtcgacacattcnctcttcacctnnggagtctgtgaacgagggacaccctgacaagctctgtgaccaggtctcagatgccgttcttgacgcttgccttgctgaggaccctgacagcaaggttgcttgtgagacctgcaccaagaccaacatggtcatggtctttggtgagatcaccaccaaggccaatgttgactacgagaagattgtcagggagacct

SEQ ID NO: 267 - DNA, 288 bp, Zea mays
  unsure (1)..(288): unsure at all n locations
gccgcaacattggtttcgtgtcgaacgatgtcgggcttgacgctgaccactgcaaggtgcttgtgaacattgagcagcagtcccctgatattgctcagggtgtgcacggccacttcaccaagcgccccgaggagattggagtggtgaccaggggcacatgtttgggtatgcgactgacgagacccctgagctgatgcccctcagccatgtcttgccaccaacttggtgctcgtctcacggagttcgccaagaatggaactgccctggcnaagcccgatggaagaccag

SEQ ID NO: 268 - DNA, 254 bp, Zea mays
  unsure (1)..(254): unsure at all n locations
gtcatcggcggnnctcacggccgacgctggcctcactggccggaagatcatcatcganacctcncggtggctggggagcccacggcgggggcgccttctccggcaaggncccgaccaaggtggaccgcagcggggcctacgtcgcgaggcaggctgccaanagcatcgtcgccgccggcctaacccgccgcgncnttgtccaggtctnctacgccatcggntnacccgagcccctttcggtgttcgtggacacg

SEQ ID NO: 269 - DNA, 525 bp, Zea mays
  unsure (1)..(525): unsure at all n locations
gggngnagggttttgtanngntnnnngggatnganngtttaccggttcggaattcccgggtcgacccacgcgtccgcccacgcgtccgcccacgcgtccgcccacgcgtccgcccacgcgtccggtcggatctgggacgagacgagacgatcccngcctcccctcaaccggaacttgttttaccccatctcatcccactgactccacccacccacccgcccgctgcctccgccggatctcgtcggactcggatccgcccgaccacgaccaccccgcgttgncgccgcgcagcagcagcagatcagagaagatggccggactcgacaccttcctcttcacctcggagtccgtgaacgagggacaccctgacaagctctgcgaccaggtctcagatgctgttctggacgcttgccttgctgaggaccctgacagcanggttgcttgcgagacctgcaccaagaccaacatggtcatggctttggtgagatcaccacccaagncaatgntgactttttnaanantttg

SEQ ID NO: 270 - DNA, 312 bp, Zea mays
ctgaagatcgtgaaggagaacttcgacttcaggcccggcatgatcatcatcaacctcgacctcaagaaaggcggcaacgggcgctacctcaagacggcggcctacgggcactttgggagggacgaccccgacttcacctgggaggtggtgaagcccctcaaggcggagaagccgtcttctgcatgaggcgcctcctctgttttggaagaagcttttggtctggtctggtctggtctggtgtgcctgcgctctatcatgcttttttatggctcctacttgtgattcttgatctgccccttgcttatcattgta

SEQ ID NO: 271 - DNA, 227 bp, Zea mays
  unsure (1)..(227): unsure at all n locations
gngagnccacggcnggggcgccttctccggcaaggacccgaccaaggtggaccgcagcgnggccnacntcgcgaggcagnctgccaanagcatcgtcgccgccggcctcncncgccgcgccattgtccaggtctcctacgccatcggcgtgcccgagcccctttcggtgttcgtggacacgtacggcaccggcgcgatccccgacaaggagatcctgaagancgtgg

SEQ ID NO: 272 - DNA, 234 bp, Zea mays
  unsure (1)..(234): unsure at all n locations
gcagcgcaagangttggtagagcgagcgagnngaaggcaatggcggcggagagcttcctgttcacctcggngtccgtgaacgaggggcacccagacaagctgtgcgaccaggtgtcggncgcggtgctggacgcctgcctggcgcaggaccccgacagcaaggtggcctgcgagacctgcaccaagacgaacntngtgatggtgttcggcgagatcnccaccaaggcgagcgtg

SEQ ID NO: 273 - DNA, 239 bp, Zea mays
cgatgagacccctgagttgatgcccctcagccatgtccttgcagtggtcggcgtcaagcccaacatcgtttgacacaaaaccaatgttgcggcaggtctccctgacaatcttctcgtagtcaacattggccttggtggtgatctcaccaaagaccatgaccatgttggtcttggtgcaggtctcacaagcaaccttgctgtcagggtcctcagcaaggcaagcgtcaagaacggcatct

SEQ ID NO: 274 - DNA, 245 bp, Zea mays
ccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgac

SEQ ID NO: 275 - DNA, 268 bp, Zea mays
cgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaaccatggtgatggtgttcggcgagatcacgaccaaggcga

SEQ ID NO: 276 - DNA, 228 bp, Zea mays
ctcacggcgatgctggcctcactggccgcaagatcatcattgacacctacggtggctggggagcccatggtggtggcgctttctccggcaaggacccaaccaaggttgaccgcagcggagcctatgtcgcaaggcaggctgccaagagcatcgtcgccagcggccttgctcgccgcgccatcgtccaggtgtcttacgccatcgggtgcccgagcctctctccgtgtt

SEQ ID NO: 277 - DNA, 253 bp, Zea mays
  unsure (1)..(253): unsure at all n locations
gatcgctgctgacctgaaggagcatgtcatcaagcctgtcatccctgagcagtaccttgacgagaagaccatcttccaccttaacccatctggccgctttgtcattggtggacctcacggcgatgctggcctcactggccgcaagatcatcattgacaccnacggtggctggggatcccnnnggggtggccttttctcggaagagggcnaaacnaaggtggncgtagtggtntttnntgaaanggtagnntgc

SEQ ID NO: 278 - DNA, 268 bp, Zea mays
  unsure (1)..(268): unsure at all n locations
ccgttcgcctcttctcctccctcctgccgggtccttaataaagagcagcagcgcaagaggttggtagagcgagcgagaagaaggcaatggcggcggagagcntcctgttcacctcggagtccgtgaacgaggggcacccagacaagctgtgcgaccaggtgtcggacgcggtgctggacgcctgcctggcgcaggaccccgacagcaaggtggcctgcgagacctgcaccaagacgaacatggtgatggtgttcggcgagatcaccac

SEQ ID NO: 279 - DNA, 218 bp, Zea mays
  unsure (1)..(218): unsure at all n locations
cccgaccaaggtggaccgcagcggggcctacgtcgcgaggcaggctgccaagagcatcgtcgccgccggcctcgcccgccgcgccatcgtccaggtctcctacgccatcgggtgcccgagcccctatcggtgttcgtggacacgtacggcancggcgcgatccccgacaaggagatcctgaagatcgtgaaggagaacttcgacttcaagcccggcat

SEQ ID NO: 280 - DNA, 314 bp, Zea mays
  unsure (1)..(314): unsure at all n locations
gccggtcccgaataaagagcagcagcgcaagaggtcggtagagcgagaagaaggcaatggcggccgagagcttccttttcaccttcggagtccgtgaacgaggggcaccccgacaagctgtgcgaccaggtgtcggacgccgtgcttgacgcatgcctcgcgcaggaccccgacagcaaggtggctgcgagactgcacaagaccaacatggtgatggtgttcggcgagatcacgaacaangcgacgtggactacgagaagatcgtgcgcgacacctgcccgcgagatcgggttcacctccgacgacgtgggctc

SEQ ID NO: 281 - DNA, 216 bp, Zea mays
  unsure (1)..(216): unsure at all n locations
ctccggcaaggacccgaccaaggtggaccgcagcggggcctacgtcgcgaggcaggctgccaagagcatcgtcgccgccggcctcgcccgccgcgccattgtccaggtctcctacgccatcgggtgcccgancccctttcggtgttcgtggacacgtacggcaccggcgcgatccccgacaaggagatcctgaagatcgtgaaggagaacttcgac

SEQ ID NO: 282 - DNA, 289 bp, Zea mays
  unsure (1)..(289): unsure at all n locations
ggccgctttgtcattggtggacctcacggcgatgctggcctcactggcngcaagatcatcattgacacctacggtggctggggagcccatggtggtggcgctttctccggcaaggacccaaccaaggttgaccgcagcggacctatgtcgcaaggcaggctgccaagagcatcgtcgccagcggccttgctcgccgcgccatcgtccagntgtcttacgccanngggtgcnngancctctctccgtgttcgaaaanannnanngcnnggnnntcccccaanggtttnct

SEQ ID NO: 283 - DNA, 247 bp, Zea mays
  unsure (1)..(247): unsure at all n locations
ctccctcttgccggtcccgaataaagagcagcancgcaagaggtcggtagagcgagaagaaggcaatggcggccgagagcttccttttcacctcggagtccgtgaacgaggggcaccccgacaagctgtgcgaccaggtgtcggacgccgtgcttnangcatgcctcgcgcaggaccccgacagcaaggtggcctgcgagacctgcaccaagaccaacatggtgatggtgttcggcgagatcacgac

SEQ ID NO: 284 - DNA, 275 bp, Zea mays
  unsure (1)..(275): unsure at all n locations
cgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaagttgctgcgaaanctgcaccaagancaacatggtgatggtgttcggcgagatcacgaccaaggggaccgtggatt

SEQ ID NO: 285 - DNA, 255 bp, Zea mays
cctcttctcctccctcctgccgggtccttaataaagagcagcagcgcaagaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcaggaccccgacagcaaggtggcctgcgagacctgcaccaagacgaacatggtgatggtgttcggcgagat

SEQ ID NO: 286 - DNA, 221 bp, Zea mays
  unsure (1)..(221): unsure at all n locations
gggagcccacggcgggggcnccttcnccggcaaggacccgaccaaggtggaccgcagcggggcctacgtcncnaggcaggcngccaagagcatcgtcnccnccggcctcgcccnccgcnccattgtccaggtctcctacgccatcgnctgcccnagcccctttcggtgttcgtggacacntacggcaccggcgcgatccccnacaaggagatcctgaagat

SEQ ID NO: 287 - DNA, 216 bp, Zea mays
  unsure (1)..(216): unsure at all n locations
ctctacccagcacgacgagacagtcaccaacgacgagattgctgctgacctgaaggagcacgtcatcaagccagtcatccccgagcagtacctcgacgagaagacaatcttccacctcaacccgtctggccgcttcgtcatcngcggacctcacggcgacgctggnctnnctgnnncggnagatcatcatcgacacctanggttgctggggagcca

SEQ ID NO: 288 - DNA, 292 bp, Zea mays
  unsure (1)..(292): unsure at all n locations
cgtacgtgtcgacacgtacggcaccggcgcgatccccgacaagganatccttcaagattgtcaaggagaacttcgatttcaagcctggcatgatcatcatcaaccttgacctcaagaaaggcggcaacgggcgctacctcaagacggcggcctacggccactttggaagggacgaccctgacttcacctgggaggtggtgaagccacttcaagtcggagaaaccttctgcctaaggcggcctttttttcagtaagaagcttttggtggtctgctgtgcttaatcagctttta

SEQ ID NO: 289 - DNA, 276 bp, Zea mays
gagaacttcgacttcaggcccggcatgatcatcatcaacctcgacctcaagaaaggcggcaacgggcgctacctcaagacggcggcctacgggcactttgggagggacgaccccgacttcacctgggaggtggtgaagcccctcaaggcggagaagccgtcttctgcatgaggcgcctcctctgtttcggaagaagcttttggtctggtctgcctgcgctctatcatgcttttttatggctcctacgtgttgtgattcttgatctgccccttgctt

SEQ ID NO: 290 - DNA, 219 bp, Zea mays
  unsure (1)..(219): unsure at all n locations
cgccatcggcgtgccggagcccctgtccgtgttcgtcaactcgtacggcaccggcacgatccccgacaaggagatcctcaagatcgtgaaggagaacttcgacttcangcccgggatgatcagcatcaacctcgacctgaagaagggcggcaacaggttcatcaagaccgccgcctacggccattcggccgtgacgacgccgacttcactgggagtggt

SEQ ID NO: 291 - DNA, 191 bp, Zea mays
catgccgcaacattggtttcgtgtcgaacgatgtcgggcttgacgctgaccactgcaaggtgcttgtgaacattgagcagcagtcccctgatattgctcagggtgtgcacggccacttcaccaagcgccccgaggagattggagctggtgaccaggggcacatgtttgggtatgcgactgacgagacccct

SEQ ID NO: 292 - DNA, 315 bp, Zea mays
  unsure (1)..(315): unsure at all n locations
gacgagacgagttaccatctcatcccaactccggaacgaacaagttaccatctcatcccaactccgcctcgaccggnncncgtcggactcgganccgcccgaccaccccgcgccgccgcagatcaaagaagatggcagcngtcgacacattcctcttcacctcggagtctgtgaacgagggacaccctgacaagcnctgtgaccaggtctcagatgccgttcttgacgcttgccttgnngaggaccctgacagcaaggttgcttgtgagacctgcaccaagaccaacatggtcatggtctttggtgagannacca

SEQ ID NO: 293 - DNA, 501 bp, Zea mays
  unsure (1)..(501): unsure at all n locations
agagcatcgnggccagcggcctcgcccgccgctgcctngtgcaaggtgtcctancccantnggngtgccggaacccctgtcaatgntcggcganttctacggcaccgggaccatncccgacaaggagatcctcaagatcgtcaaggagaacttcgacttcaggccccgggatnatcaccatcaacctcgacctcaanaaagggcggcaacaggttcatcaagaccgccgcatacngncactttggcccgtgacgancncactttacctgggaagtggtcaatcccctaaagaaagccatnccncttaagaatgtanttggnaagtttacttggacatgaagttcattcttngtctngcttctgctgatnccctnnaangattgcttgntncttgcttgcccctngattgtntgttttgancaantganttngcttgntcttgttccatntgaaaaaccnnattaatngtggnccntttggtgaaaaaaagntttngccnat

SEQ ID NO: 294 - DNA, 281 bp, Zea mays
  unsure (1)..(281): unsure at all n locations
gcctcttctcctccctcctgccgggtccttaataaagagcagcagcgcaagaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcagaaccccgacagcaagtggcctgcgagacctgcaccaagacgaacatggtgatggtgttcggcgaantcaccaccagggnagntggatacgaat

SEQ ID NO: 295 - DNA, 486 bp, Zea mays
  unsure (1)..(486): unsure at all n locations
gggnanttnttnnagnccttcnacgcgnncagtaccggtcacagaattcccgggncgaccacgcgtccncggacgcgtgggcgacaaggagatcctcangatcgtgaaggagannttcacttcaggcccgggatgatcagcatcaacctcgacctgaagaagggcggcaacaggttctcaagaccgccgcctacggccacttcggccgtgacnacgccgacttcacctgggaggtgtgaagcccctcaagttcgacaaggcatcggcttaaggttgggantgtcactgtggacataggactaccttcctctggctctgctgttacctgcaagcattgctgctgctggatgtgtggtttgatcagtgactggctgctgctccatagaagatgaacggagagaaggatgatgaangctttggcaatcgcccgctgcaactgcaacccatgccatgccggcttaatgattgggtaaattttggcttnca

SEQ ID NO: 296 - DNA, 173 bp, Zea mays
tacgtcgccaggcaggccgccaagagcatcgtggccagcggcctcgcccgccgctgcctcgtgcaggtgtcctacgccatcggcgtgccggagcccctgtccgtgttcgtcgactcctacggcaccgggaccatccccgacaaggagatcctaaagatcgtcaaggagaactt

SEQ ID NO: 297 - DNA, 278 bp, Zea mays
  unsure (1)..(278): unsure at all n locations
cgcctcttctcctccctcctgccgggtccttaataaagagcagcagcgcaagaggttggtagagcgagcgagaagaaggcaatggcggcggagagcttcctgttcacctcggagtccgtgaacgaggggcacccagacaagctgtgcgaccaggtgtcggacgcggtgctggacgcctgcntggcgcaggaccccgacagcaaggtggcctgcnatncctncacnangacgaacatggtgatggtgttcggcgaaatcaccncnantgcgacntngac

SEQ ID NO: 298 - DNA, 309 bp, Zea mays
  unsure (1)..(309): unsure at all n locations
ggcgtgccggagcccctgtccgtgttcgtcgactcctacggcaccgggaccatccccgacaaggagatcctaaagatcgtcaaggagaacttcgacttcaggccagggatgatcaccatcaacctcgacctcaagaagggcggcaacaggttcatcaagaccgccgcatacggccactttggcntgacgacgccgacttcacctgggaggtggtcaagcccctaaagaaggcatccgcttaagaatgtattgggaagttcactggacatgaggttcatcttcgtctggctctgctgatacctgcaagat

SEQ ID NO: 299 - DNA, 197 bp, Zea mays
  unsure (1)..(197): unsure at all n locations
gggagaccngccgcaacattggttttgtgtcaaacgatgttgggcttgacgccgaccacngcaaggtgctcgtgaacattgagcagcagtcccctgatattgctcagggtgtgcatggccacttcaccaagcgccccgaggagattggagctggtgaccagggacacatgttcgggtatgcgaccgatgagacccct

SEQ ID NO: 300 - DNA, 253 bp, Zea mays
  unsure (1)..(253): unsure at all n locations
cgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggctgcgagacctgcaccnagaccaacatggtgatngtgttcggcgagatc

SEQ ID NO: 301 - DNA, 302 bp, Zea mays
  unsure (1)..(302): unsure at all n locations
cgtgaaacgaggggacaccctgacaagctctgcgaccaggtctcagatgctgttctggacgcttgccttgctgaggaccctgacagcaagttgcttggagacctgcaccaagaccaacatggtcatggtctttggtgagatcaccaccaaggccaatgtcgactacgagaagattgtcaggggagacatgccgcaaaattggtttcgngtnaganngatgtggggcttgangntgaccacngcanggtgntnatanaaanttngnagnantnccctgtatttgcgcnggggggnncncccnc

SEQ ID NO: 302 - DNA, 460 bp, Zea mays
  unsure (1)..(460): unsure at all n locations
cgccgccggcctcgcccgccgcgccatcgtccaggtctcctacgccatcggcgtgcccgagcccctatcggtgttcgtggacacgtacnggancngngcnanncccgacnagggnaatcntganaatngnanaagganaanttnanantncaggcccggttgatcattatnaacctagacctcaanaaaggcggaaacgggcnctacctaaagacgggggtctacgggcnctttgngagggacgaccgaganttcacctgagaggtggnaaagcccctcaaggcggaaaagccgtcttctgcatgaggcgcctcctctgtttcngaagaagcttttggtctggtctgcctgcgctctatcatgcttttttatggctnctacgtgttgtgattcttgatctgccccttgcttatcatttgtactgtactgtcactgtcctaataagtggtacgtgtgcggg

SEQ ID NO: 303 - DNA, 297 bp, Zea mays
  unsure (1)..(297): unsure at all n locations
gtctatgtngcaangnacgctgcnaagagcatngtcncccagcggccttgctcgcngcgcnatngncccaggtgtattatcgccatccggcnngncngngcntctcnccgtgttcgtcgacacgtacggcaccggcgcgatccccgacaaggngnncnctgaagattgtacaaggagaacttcgatttcaggcctggcatgatcatnnncaaccttganctcaagaaaggnggcaacgggcgctacctcaagacggcggcctacggcnactttggaagggacgaccctgacttcacc

SEQ ID NO: 304 - DNA, 259 bp, Zea mays
  unsure (1)..(259): unsure at all n locations
cggatctgagacgagacgagttaccatctcatcccaactccggaacgaacaagttaccatctcatcncaactccgtctcaccgaggtccgcaagaacggaacctgcccctggctcaggcctgatgggaagacccaggtgacagtcgagtaccgcaatgagggtggtgccatggtccccatccgtgtccacaccgtcctcatctccacccagcacgacgagacagtgaccaatgatgagatcgctgctgacctgaaggag

SEQ ID NO: 305 - DNA, 244 bp, Zea mays
  unsure (1)..(244): unsure at all n locations
cttctcctccctcctgccgggtccttaataaagagcagcagcgcaagaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcaggaccccgacagcaaggtggcctgcganacctgcaccaagacgaacatggtgatggtgttc

SEQ ID NO: 306 - DNA, 236 bp, Zea mays
cgtcggactcggatccgcccgaccacgaccaccccgcgccgccgccgcgcacagcagcagatcagagaagatggccggactcgacaccttcctcttcacctcggagtccgtgaacgagggacaccctgacaagctctgcgaccaggtctcagatgctgttctggacgcttgccttgctgaggaccctgacagcaaggttgcttgcgagacctgcaccaagaccaacatggtcatgg

SEQ ID NO: 307 - DNA, 310 bp, Zea mays
  unsure (1)..(310): unsure at all n locations
cccagcacgacgagacagtcaccaacgacgagattnctgggtagagatgaggactgtgtgcacacggatgggaaccatggcgccaccctcatctctacccagcacnacgagacagtcaccaacgacgagattgctgctgacctgaaggagcacgtcatcaagccagtcatccccgagcagtacctcgacgagaagacaatcttacacctcaacccgtctggccgcttcgtcatcggcggacctcacggcgaggtgggcntnactggccggangatntcatcganannaggtgtttgggganccacggggg

SEQ ID NO: 308 - DNA, 185 bp, Zea mays
cctgacagcaaggttgcttgcgagacctgcaccaagaccaacatggtcatggtctttggtgagatcaccaccaaggccaatgtcgactacgagaagattgtcagggagacatgccgcaacattggtttcgtgtcgaacgatgtcgggcttgacgctgaccactgcaagtgcttgtgaacattgag

SEQ ID NO: 309 - DNA, 272 bp, Zea mays
ccgtttgcctcttctccctcttgccggtcccgaataaagagcagcagcgcaagaggtcggtagagcgagaagaaggcaatggcggccgagagcttccttttcacctcgggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcgagatcacgaccaaggcgaccg

SEQ ID NO: 310 - DNA, 231 bp, Zea mays
ctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagaccaacatggtgat

SEQ ID NO: 311 - DNA, 307 bp, Zea mays
  unsure (1)..(307): unsure at all n locations
gtcggatctgagacgagacgagtcccctcgcntcacccaaccggaacgaacaagttaccatctcatcccaaccccgcctgcgaccggntgtcgtcggactcggntccgcncgaccaccccgcgccgccgcagatcaaagaagatggcagctctcgacaccttcctcttcacctcggagtctgtgaacgagggacaccctgacaagctctgcgaccaggtctcagatgccgttcttgacgcttgcnttgctgaggaccctgacagcaaggttgcttgtgagacctgcaccaagaccaacatggtcatg

SEQ ID NO: 312 - DNA, 260 bp, Zea mays
catccatccccgttcgcctcttctcctccctcctgccgggtccttaataaagagcagcagcgcaagaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcaggaccccgacagcaaggtggcctgcgagacctgcaccaagacgaacatggtgatggtg

SEQ ID NO: 313 - DNA, 305 bp, Zea mays
tgagacgagacgagttaccatctcatcccaactccggaacgaacaagttaccatctcatcccaactccgcctcgaccggatctcgtcggactcggatccgcccgaccaccccgcgccgccgcagatcaaagaagatggcagctgtcgacacattcctcttcacctcggagtctgtgaacgagggacaccctgacaagctctgtgaccaggtctcagatgccgttcttgacgcttgccttgctgaggaccctgacagcaaggttgcttgtgagacctgcaccaagacaacatggtcatggtctttg

SEQ ID NO: 314 - DNA, 237 bp, Zea mays
  unsure (1)..(237): unsure at all n locations
gaagattntcatggatacctgccgcancattngntttgtgatcanacgatgctgggnttgacgccnaccactgnaaggtgcncgtgaanattgatcancagtcncctgatattgctcanggtntncatggccacttcaccaagcgccccgaggagattggagctggngaccagggacacatgttcgggtatgctaccnantagacccntgagttgatgcccctcagccatgtccttg

SEQ ID NO: 315 - DNA, 280 bp, Zea mays
  unsure (1)..(280): unsure at all n locations
tctcatcccactgactccgnccacccacccgcccgctgcctccgccggatctcgtcggactcggatccgcccgaccacgaccaccccgcgccgccgccgcgcagagcagcagatcagagaagatggccggactcgacaccttcctcttcacctcggagtccgtgaacgagggacaccctgacaagctctgcgaccaggtctcagatgctgttctggacgcttgccttgctgaggaccctgacagcaaggttgcttgcgagacctgcaccaagaccaacat

SEQ ID NO: 316 - DNA, 269 bp, Zea mays
  unsure (1)..(269): unsure at all n locations
cgtgaaggagaacttcgacttcaggcccgggatgatcagcatcaacctcgacctgaagaagggcggcaacaggttcatcaagaccgccgcctacggccacttcggccgtgacgacgccgacttcacctgggaggtggtgaagcccctcaagttcgacaaggcatcggcttaaggttgggagtgtcactgtggacatgaggactaccttcctctggctctgctgttacctgcaagcattgctgctgctggatgngtgtgtttgatcatga

SEQ ID NO: 317 - DNA, 229 bp, Zea mays
ccgacaaggagatcctaaagatcgtcaaggagaacttcgacttcaggccagggatgatcaccatcaacctcgacctcaagaagggcggcaacaggttcatcaagaccgccgcatacggccactttggccgtgacgacgccgacttcacctgggaggtggtcaagcccctaaagaaggcatccgcttaagaatgtattgggaagttcatggacatgaggttcatcttcgt

SEQ ID NO: 318 - DNA, 418 bp, Zea mays
  unsure (1)..(418): unsure at all n locations
tatcatcgtnnccagctgnctctnccncnnggngcctttngcaagtntcctangccatcgncgtgccngancccctgtccntgttcgtcgactcctacngnaccnggaccatncccgacaaggagatcctaaagatcttcaaggagaacttcnacttcangccanggatgatcaccatcaacctcgacctcaagaaggncggcaacaggttcatcaagaccgncnnatacggcactttngccgtgacgactcctacttcacctgagaagtggtcaaacccctaaagaaagcattcncttaaaaatgtattnggaanttnaactggacattatgttcatntttcntcttggttcttctnatacctgcaaagattgctgnttcttctntccnnccttggatgtgtgtttgancaatgant

SEQ ID NO: 319 - DNA, 267 bp, Zea mays
  unsure (1)..(267): unsure at all n locations
acgccatcggcgtgccggagcccctgtccgtgttcgtcgacacctacggcaccgnngaccatccccgacaaggagatcctaaagatcgtcaaggagaacttcgacttcaggccagggatgatcaccatcaacctcgacctcnagaagggnggcaacnggntcntnaagancggnggaanaggctatttggncgtgaanggntcggattcancctggtggggtggtaannccctnaaangngnnnncctgttnnaagnttttggggag

SEQ ID NO: 320 - DNA, 179 bp, Zea mays
  unsure (1)..(179): unsure at all n locations
cccctggctcaggcccgatgggaagacccaggtgacantggagtaccgcaacgagggtggcgccatggttcccatccgtgtgcacacagtcctcatctctacncagcacgacgagacagtcaccaacgacgagattgctgctgacctgaaggagcacgtcatcaagccagtcatccccg

SEQ ID NO: 321 - DNA, 280 bp, Zea mays
cttcacgatcttgaggatctccttgtcggggatcgtgccggagaacttcgacttcaggcccgggatgatcagcatcaacctcgacctgaagaagggcggcaacaggttcatcaagaccgccgcctacggccacttcggccgtgacgacgccgacttcacctgggaggtggtgaagcccctcaagttcgacaaggcatcggcttaaggttgggagtgtcactgtggacatgaggactaccttcctctggctctgctgttacctgcaagcattgctgctgct

SEQ ID NO: 322 - DNA, 294 bp, Zea mays
  unsure (1)..(294): unsure at all n locations
ctcttctccctcttgccggtcccgaataangagcagcagcgcnagaggtcggtagagcgagangnaggcaatggcggccgagngttccttttcaaccttcggagtccgtgaacgnggggcnccccgaacaagctgtgcgaccaggtgtcggacgccgtgcttgatgcatgcctcgcgcngganccccgacagcnaggtggcctgcgagatctgcaccaagaccaacatggtgatggtgttcggcgagatcacgatcaaggcgancgtggactacgngaagatcgtgcgcgacac

SEQ ID NO: 323 - DNA, 280 bp, Zea mays
  unsure (1)..(280): unsure at all n locations
ggggagcccatggtggtggcgctttctccggncaccgtaggtgtncaatgatgatcttgcggccagtgaggccatcattgacacctacggtggctggggagcccatngtggtggcgctttctccggcaaggacccaaccaaggttgaccgcagcggagcctatgtcgcaaggctggctgccaagagcatcgttcgccagcggccttgctncgccgcgccatcgtccaggtgtcttacgccatcggntggcccgagcctctctccgtgttcgtcgacacta

SEQ ID NO: 324 - DNA, 273 bp, Zea mays
ccgttcgcctctttctcctccctcctgccgggtccttaataaagagcagcagcgcaaggtgagccgccagcttgccccaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcaggaccccgacagcaagtggctgcgagacctgcaccaagacgaacatggtgatggtgttc

SEQ ID NO: 325 - DNA, 215 bp, Zea mays
ctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcaggaccccgacagcaaggtggcctgcgagacctgcaccaagacc

SEQ ID NO: 326 - DNA, 291 bp, Zea mays
gggagaacttcgacttcaggcccgggatgatcagcatcaacctcgacctgaagaagggcggcaacaggttcatcaagaccgccgcctacggccacttcggccgtgacgacgccgacttcacctgggaggtggtgaagcccctcaagttcgacaaggcatcggcttaaggttgggagtgtcactgtggacatgaggactaccttcctctggctctgctgttacctgcaagcattgctgctgctggatgtgtgtgtttgatcagtgactggctgctgctccatagaagatgaa

SEQ ID NO: 327 - DNA, 173 bp, Zea mays
ggtgagatcaccaccaaggccaatgtcgactacgagaagattgtcagggagacatgccgcaacattggtttcgtgtcgaacgatgtcgggcttgacgctgaccactgcaagtgcttgtgaacattgagcagcagtcccctgatattgctcagggtgtgcacggccacttcacc

SEQ ID NO: 328 - DNA, 156 bp, Zea mays
  unsure (1)..(156): unsure at all n locations
angaggggcaccccgacaagctgtgcgaccaggtgtcggacgccgtgcttgacgcatgcctcgcgcaggaccccgacagcaaggtggcctgcgagacctgcaccaagaccaacatggtgatggtgttcggcnagatcacgaccanggcgaccgtnt

SEQ ID NO: 329 - DNA, 178 bp, Zea mays
  unsure (1)..(178): unsure at all n locations
cccacggcgggggcgccttctccggcaaggacccgaccaaggtggaccgcagcggggcctacgtcgcgaggnaggctgccaagagcatcgtcgccgccggcctcgcccgcngcgccattgtccaggtctcctacgccatcggcgtgcccgancccctttcggtgttcgtggacacgta

SEQ ID NO: 330 - DNA, 176 bp, Zea mays
  unsure (1)..(176): unsure at all n locations
tagttctagatcggcaagngcnnccnttgncanatgttcgggtacgccaccgacgagacccccgagctgatgccgctgagccacgtgctggccaccaagctgggcgcgcgcctcaccgaggtgcgcaagaacggcacctgcgcctggctgaggcccgacggcaagacccaggtgac

SEQ ID NO: 331 - DNA, 263 bp, Zea mays
  unsure (1)..(263): unsure at all n locations
cttctcnctcttgccggtnncgnntaaagancagcagcgcaagaggtcggtagagcgatgaagaaggcaatggcggccgnnagcttccttttcacctcngantccgtgaacgangggcanccnganaagctgtgcgnccangtntcggacgccgtgcttgacgcatgcctcgcgcaggancccgacagcaaggtggatgcgagacctgcataagaccaacatggtgatggtgttcgncgagatcacgaccaaggcgnccgtgg

SEQ ID NO: 332 - DNA, 225 bp, Zea mays
  unsure (1)..(225): unsure at all n locations
cgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcntgacgcatgcctcgcgcaggaccccgacagcaaggtggcctgcgagacctgcaccanga

SEQ ID NO: 333 - DNA, 331 bp, Zea mays
  unsure (1)..(331): unsure at all n locations
gtcggatctgagacgagacgagacgannncccctcccctcaaccggaacttgttttaccccatctcatcccactgactccnnccacccacccgcccgcngcctccgccggatctcgtcggactcggatccgcncgaccacgaccaccccgcgtcgccgccgcgcanagcagcagatcagagaagatggccggactcgacaccttcctcttcacctcggagtccgtgaacgagggacaccctgacaagctctgcgaccaggtctcagatgctgttctggacgcttgccttgctgaggaccctgacagcaaggttgcttgcgagacctgcacc

SEQ ID NO: 334 - DNA, 166 bp, Zea mays
  unsure (1)..(166): unsure at all n locations
ggaagacccaggtgacagtggagtaccgcaacgagggtggcgccatggttcccatccgtgtgcacacagtcntcatctctacccagcacgacgagacagtcaccaacgacgagattgctgctgacctgaaggagcacgtcatcaagccagtcatccccgagcagta

SEQ ID NO: 335 - DNA, 170 bp, Zea mays
  unsure (1)..(170): unsure at all n locations
ccatggttcccatccgtgtgcacacagtcctcatctctacccagcacgacgagacagtcaccaacgacgagattgctgctgacctgaaggagcacgtcatcaagccagtcatccccgagcagtacctcgacgagaagacaatnttccacctcaaccngttggnggttcgt

SEQ ID NO: 336 - DNA, 247 bp, Zea mays
atcatcaacctcgacctcaagaaaggcggcaacgggcgctacctcaagacggcggcctacgggcactttgggagggacgaccccgacttcacctgggaggtggtgaagcccctcaaggcggagaagccgtcttctgcatgaggcgcctcctctgtttcggaagaagcttttggtctggtctgcctgcgctctatcatgcttttttatggctcctacgtgttgtgattcttgatctgccccttgctta

SEQ ID NO: 337 - DNA, 196 bp, Zea mays
  unsure (1)..(196): unsure at all n locations
gcagtnccctgatatngctcagggtgtgcatggccacttcaccaagcgccccgaggagattngagcnggtgaccagggacacatgttanggtatgcgaccgatgagacncctgagttgatgcccctcagccatgtccttgccaccaagctaggtgcacgtntcaaccgaggtccgcaagaacggaaccngccactg

SEQ ID NO: 338 - DNA, 211 bp, Zea mays
  unsure (1)..(211): unsure at all n locations
ctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcntcgcgcaggaccccgacagcaaggtggcctgcgagacctncaccaa

SEQ ID NO: 339 - DNA, 302 bp, Zea mays
  unsure (1)..(302): unsure at all n locations
gacgagacgagttaccatctcatcccaactccggaacgaacaagttaccatctcatcccaactnccgccttcgaccggatctncgtcggactcggatccgcccgaccaccccgcgccgccgcagatcaaagaagatggcagctgtcgacacattcctcttcacctcggagtctgtgaacgagggacaccctgacaagctctgtgaccaggtctcagatgccgttcttgacgcttgccttgctgaggaccctgacagcaagttgcttgtgagactgcaccaagaccaacatggtcatggtctt

SEQ ID NO: 340 - DNA, 263 bp, Zea mays
  unsure (1)..(263): unsure at all n locations
tcgacttcaggcccgggatgatcagcatcaacctcgacctgaagaagggcgncaacaggttcatcaagaccgccgcctacggccacttcggccgtgacgacgccgacttcacctgggaggtggtgaagcccctcaagttcgacaaggcatcggcttaaggttgggagtgtcactgtggacatgaggactaccttcctctggctctgctgttacctgcaagcattgctgctctggatgtgngtgttaatcaganactgctgctc

SEQ ID NO: 341 - DNA, 300 bp, Zea mays
  unsure (1)..(300): unsure at all n locations
cttcgnacttcaggcccgggatgatcagcatcaacctcgacctgaagaagggcggcaacaggttcatcaagaccgccgcctacggccacttcggccgtgacgacgccgacttcacctgggaggtggtgaagcccctcaagttcgacaaggcatcggcttaaggttgggagtgtcactgtggacatgaggactaccttcctctggctctgctgttacctgcaagcattgctgctgctggatgtgtgtgtttgatcagtgactggctgctgctccatagaagatgaacggagagaaggatga

SEQ ID NO: 342 - DNA, 249 bp, Zea mays
  unsure (1)..(249): unsure at all n locations
atccgtttgcctcttctccctcttgccggtcccgaataaagancagcagcgcaagaggtcggtanagcgagaagaaggcaatggcggccgagagttccttttcacntcggagtccgtgaacgaggggcaccccgacaagctgtgcgaccagntgtcggacgccgtgcttgangcatgnctcgcgcaggaccccgacagcaaggtggcctgcgagactgcaccaagaccaanntggtgatggtgttcggc

SEQ ID NO: 343 - DNA, 196 bp, Zea mays
  unsure (1)..(196): unsure at all n locations
caatctnccacntcaacccgnctgagncgcttcgncatcggcggacctcacggcgacgcnggnctcantggccggaagatacatcatcgacacctacggnggctggggagcccacggcgggggcgcctnctccggcaaggncccgaccaaggtggacngcagcggggcctacgtcgcgangnaggctgccaagagc

SEQ ID NO: 344 - DNA, 249 bp, Zea mays
  unsure (1)..(249): unsure at all n locations
atcaacctcgacctcaagaaaggcggcaacgggcgctacctcaagacggcggcctacgggcactttgggagggacgaccccgacttcacctgggaggtggtgaagcccctcaaggcggagaagccgtcttctgcagaggcgcctcctctgttttggaagaagcttttggtctgncctggtctggtctggtgtgccncgcgctctatcatgcttttttatggctcctacttgtgattcttnatctgcccc

SEQ ID NO: 345 - DNA, 143 bp, Zea mays
  unsure (1)..(143): unsure at all n locations
cgactcctacggcaccgggaccatccccgacaaggagatcctaaagatcgtcaaggagaacttcgacttcaggccagggatggtcaccatcaacctcgacctcaagaagggcggcaacaggttcatcaagaccgccgcatang

SEQ ID NO: 346 - DNA, 142 bp, Zea mays
  unsure (1)..(142): unsure at all n locations
ccgagcctctctccgtgttcgtngacacgtacggcaccggcgcgatccccgacaaggagatcctcaagattgtcaaggagaacttcgatttcaggcctggcatgatcatcatcaaccttgacctcaagaaaggcggcaacgg

SEQ ID NO: 347 - DNA, 288 bp, Zea mays
  unsure (1)..(288): unsure at all n locations
cgagacgagtnaccatntcatncccaacnccggaacgaacaagttaccatntcatncccaacncccgcctcgaccggatctccgtcggactccggatccgcccgaccacnccgcgccgccgcagatcaaagaagatggcagctgtcgacacattcctcttcacntcggagtctgtgaacgagggacacnctgacaagctctgtgaanaggtctcagatgccgttcttgacgcttgcnttgctgaggaccctgacagcaaggttgcttgtgagaccngcaccaagacca

SEQ ID NO: 348 - DNA, 288 bp, Zea mays
  unsure (1)..(288): unsure at all n locations
gagacgagacgagtcccctccccccacctcgcctcacccaaccggaacgaacaagttacaatctcatcccaaccccgcctccgaccggatctcgtcggactcggatccgcccgaccaccccgcgccgccgcagatcaaagaagatggcagctgtcgacacattcctcttcacctcggagtctgtgaacgagggacaccctgacaagctctgtgaccaggtctcagatgccgttcttgacgcttgcnttgctgaggaccctgacagcaaggttgcttgtgagacctgca

SEQ ID NO: 349 - DNA, 147 bp, Zea mays
ccgacaaggagatcctaaagatcgtcaaggagaacttcgacttcaggccagggatgatcaccatcaacctcgacctcaagaagggcggcaacaggttcatcaagaccgccgcatacggccactttggccgtgacgacgccgacttca

SEQ ID NO: 350 - DNA, 264 bp, Zea mays
  unsure (1)..(264): unsure at all n locations
cttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccagtgtggacgccgtgcttnacgcatgcctcgcgcagaccccgacagcaaggtggcctgcgagacctgcaccaagaccaacaatgtgatngtgttcggcgagatnagancaaagngactgngatnca

SEQ ID NO: 351 - DNA, 235 bp, Zea mays
  unsure (1)..(235): unsure at all n locations
cgcctcttctcctccctcctgccgggtccttantaaagagcagcagcgcaagaggttggtagagcgagcgagaagaaggcaatggcggcggagagcttcctgttcacctcggagtccgtgaacgaggggcacccagacaagctgtgcgaccaggtgtcggacgcggtcntgacggcttcctggngcaggaccccgacagcaaggtggcctgcgagacctgcaccaagangaacat

SEQ ID NO: 352 - DNA, 211 bp, Zea mays
  unsure (1)..(211): unsure at all n locations
cgtttgcctcttctccctcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcntcgcgcaggaccccgacagcaaggtggcctgcna

SEQ ID NO: 353 - DNA, 212 bp, Zea mays
  unsure (1)..(212): unsure at all n locations
gtttgcntcttctccctcttgccggtcccgaataaagagcagcagcgcaagaggtcggtagagcgagaagaaggcaatggcggccgagagcttccttttcacatcggagtccgtgaacgagggncacnccgacaagctgtgcgaccaggtgtcggacgccgtgcttgacgcatgcntcgcgcaggaccccgacagcaaggtggcctgcgaga

SEQ ID NO: 354 - DNA, 490 bp, Zea mays
  unsure (1)..(490): unsure at all n locations
taaagatcgtcaaggagaacttcgacttcaggccagggatggtcaccatcaacctcgacctcaagaagggcggcaacaggttcatcaagaccgccgcatacggccactttggccgtgacgacnccgacttcacctgggaggtggtcaagcccctaaagaaggcatccgcttaagaatgtattgggaagttcactggacatgaggttcatcttcgtctggctctgctgatacctgcaaggatnnnnnnnnnnnnnnnnnncctggatgtgtgtttgatcagtgactggctgctctgctccatagaagatgaatgaagagagagatggtgaanaaggctttggcaaatggcaattgccgaacaagccatgtcgcnccactgaccggcttaatgattggtataatttggtgtggcaacanccaggattaatgcccctggncttttatcnttactactaanttgggctngtccggtatctaattttctttccct

SEQ ID NO: 355 - DNA, 389 bp, Zea mays
  unsure (1)..(389): unsure at all n locations
gnnnaggccnttgananggggggnttnatgaatcngtaccggtccggaattcccgggtcgacccacgcgtccgcggacgcgtgggcctcgacctcaagaaaggcggcaacgggcgctacctcaagacggnggcctacgggcactttgggagggacgaccccgacttcacctgggaggtggtgaagcccctcaaggcggagaagccgtcttctgcatgaggcgcctcctctgtttcggaagaagcttttggtctggtctgcctgcgctctatcatgcttttttatggctcctacgtgttgtgattcttgatctgccccttgcttatcatttgtattgtactgtcactgtcctaataagtggtacgtgtgcggggtcgtattgtgtctgct

SEQ ID NO: 356 - DNA, 289 bp, Zea mays
gtcggatctgagacgagacgagtcccctccccccacctcgcctcacccaaccggaacgaacaagttacaatctcatcccaaccccgcctcgaccggatctcgtcggactcggatccgcccgaccaccccgcgccgccgcagatcaaagaagatggcagctgtcgacacattcctcttcacctcggagtctgtgaacgagggacaccctgacaagctctgtgaccaggtctcagatgccgttcttgacgcttgccttgctgaggaccctgacagcaaggttgcttgtgag

SEQ ID NO: 357 - DNA, 264 bp, Zea mays
gggatgatcagcatcaacctcgacctgaagaagggcggcaacaggttcatcaagaccgccgcctacggccacttcggccgtgacgacgccgacttcacctgggaggtggtgaagcccctcaagttcgacaaggcatcggcttaaggttgggagtgtcactgtggacatgaggactaccttcctctggctctgctgttacctgcaagcattgctgctgctggatgtgtgtgtttgatcagtgactggctgctgctccatagaaga

SEQ ID NO: 358 - DNA, 263 bp, Zea mays
  unsure (1)..(263): unsure at all n locations
gggatgatcagcatcaacctcgacctgaagaagggcggcaacaggttcatcaagaccgccgcctacggccacttcggccgtgacgacgccgacttcacctgggaggtggtgaagcccctcaagttcgacaaggcatcggcttaaggttgggagtgtcactgtggacatgaggactaccttcctctggctctgctgtnacctgcaagcnttgctgctgctggatgtntgtgtttgatcagtgantggctgctgctccatagang

SEQ ID NO: 359 - DNA, 268 bp, Zea mays
gagacgagacgagttaccatctcatcccaactccggaacgaacaagttaccatctcatcccaactccgcctcgaccggatctcgtcggactcggatccgcccgaccaccccgcgccgccgcagatcaaagaagatggcagctgtcgacacattcctcttcacctcggagtctgtgaacgagggacaccctgacaagctctgtgaccaggtctcagatgccgttcttgacgcttgccttgctgaggaccctgacagcaaggttgcttgt

SEQ ID NO: 360 - DNA, 289 bp, Zea mays
  unsure (1)..(289): unsure at all n locations
gtcggatctgagacgagacgagtcccctccccccacctncgcctcacccaaccggaacgaacaagttacaattctcatcccaaccccgcctcgancggatctcgtcggactcggatccgcccgaccaccccgcgccgccgcagatcaaagaagatggcagctgtcgacacattcctcttcacctcggagtctgtgaacgagggacaccctgacaagctctgtgaccaggtctcagatgccgttcttgacgcttgccttgctgaggaccctgacagcaaggttgcttgtg

SEQ ID NO: 361 - DNA, 252 bp, Zea mays
  unsure (1)..(252): unsure at all n locations
ctcttctccctcttgccggtcccgaataaagagcagcagcgcaagaggtcggtagagcgagaagaaggcaatggcggccgagagcttccttttcacctcggagtccgtgaacgaggggcacccgacaagctgtgcgaccaggtgtcggacgccgtgcttnacgcatgcctcggcaggaccccgaaacaagtggctggagaccttcaccaagancaatntggtgatggtgttcggngaatcacgacaaggcga

SEQ ID NO: 362 - DNA, 246 bp, Zea mays
gatcagcatcaacctcgacctgaagaagggcggcaacaggttcatcaagaccgccgcctacggccacttcggccgtgacgacgccgacttcacctgggaggtggtgaagcccctcaagttcgacaaggcatcggcttaaggttgggagtgtcactgtggacatgaggactaccttcctctggctctgctgttacctgcaagcattgctgctgctggatgtgtgtgtttgatcagtgactggctgct

SEQ ID NO: 363 - DNA, 240 bp, Zea mays
  unsure (1)..(240): unsure at all n locations
cgacctggncgnggacgcgtggcnngaacgcgtngggcccggcctcganccgccncgccattgtccaggatntcctacgccangcggctgcccanancccctttcggtgttcgtggacacgtacggcaccggcgcgatccccgacaaggagatcctgaagatcgtgaaggagaacttcgacttcaggcccggcatgntcatcatcaacctcgacctcaagaaaggcngcaagggcgtact

SEQ ID NO: 364 - DNA, 270 bp, Zea mays
  unsure (1)..(270): unsure at all n locations
gacgagacgagtcccctccccccacctacgcctcacccaaccggaacgaacaagttacaatctcatcccaaccccgcctncgaccggatctcgtcggactcggatccgcccgaccaccccgcgccgccgcagatcaaagaagatggcagctgtcgacacattcctcttcacctcggagtctgtgaacgagggacaccctgacaagctctgtgaccaggtctcagatgccgttcttgacgcttgccttgctgaggaccctgacagcaaggt

SEQ ID NO: 365 - DNA, 252 bp, Zea mays
  unsure (1)..(252): unsure at all n locations
ttctagatcgcgggcggccgctcgcccacgcgtccgatccccgttcgcctcttctcctccctcctgccgggtccttaataaagagcagcagcgcaagaggttggtagagcgagcgagaagaaggcaatggcggcggagagcttcctgttcacctcggagtccgtgaacgaggggcacccagacaagctgtgcgaccaggtgtcngacgcngtgctggacgcctgcctggcgcaggaccccgacagcaaggtg

SEQ ID NO: 366 - DNA, 320 bp, Zea mays
  unsure (1)..(320): unsure at all n locations
gtcggatctgagacgagacgangngnccctcccctcaaccggaacttgttttaccccatctcatcccactgactccngccacccacnannncnntgcctccgccggatctcgtcggactcggatccgcccgaccacgaccaccccgcgccgccgccgcgcagagcagcagatcagagaagatggccggactcgacaccttcctcttnacctcggagtccgtgaacgagggacaccctgacaagctctgcgaccaggtctcagatgctgttctggacgcttgccttgctgaggaccctgacagaaagttgttgcgagactg

SEQ ID NO: 367 - DNA, 274 bp, Zea mays
ggccgggtcggatctgagacgagacgagttaccatctcatcccaactccggaacgaacaagttaccatctcatcccaactccgcctcgaccggatctcgtcggactcggatccgcccgaccaccccgcgccgccgcagatcaaagaagatggcagctgtcgacacattcctcttcacctcggagtctgtgaacgagggacaccctgacaagctctgtgaccaggtctcagatgccgttcttgacgcttgccttgctgaggaccctgacagcaag

SEQ ID NO: 368 - DNA, 271 bp, Zea mays
gtcggatctgagacgagacgagttaccatctcatcccaactccggaacgaacaagttaccatctcatcccaactccgcctcgaccggatctcgtcggactcggatccgcccgaccaccccgcgccgccgcagatcaaagaagatggcagctgtcgacacattcctcttcacctcggagtctgtgaacgagggacaccctgacaagctctgtgaccaggtctcagatgccgttcttgacgcttgccttgctgaggaccctgacagcaagttg

SEQ ID NO: 369 - DNA, 274 bp, Zea mays
  unsure (1)..(274): unsure at all n locations
gacgagacgagtcccctnacccccacctacgcctcacccaaccggaacgaacaagttacaatactgcatcccaaccccgcctcgaccggatctcgtcggactcggatccgcccgaccaccccgcgccgccgcagatcaaagaagatggcagctgtcgacacattcctcttcacctcggagtctgtgaacgagggacaccctgacaagctctgtgaccaggtctcagatgccgttcttgacgcttgccttgctgaggaacctgacagcaaggttg

SEQ ID NO: 370 - DNA, 203 bp, Zea mays
  unsure (1)..(203): unsure at all n locations
ctcttctccctcttgccgntcccgaataaagagcagcagcgcaagaggtcggtagagcgagaagaaggcaatggcggccgagagcttccttttcacntcggagtccgtgaacgaggggcacgccgacaagctgtgcgaccaggtgtcggacgccgtgcttgacgcatgcctcgcgcaggacnccgacagcaagtggcctgcga

SEQ ID NO: 371 - DNA, 201 bp, Zea mays
gcctcttctcctccctcctgccgggtccttaataaagagcagcagcgcaagaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcaggaccccgacagca

SEQ ID NO: 372 - DNA, 307 bp, Zea mays
tcagcatcaacctcgacctgaagaagggcggcaacaggttcatcaagaccgccgcctacggccacttcggccgtgacgacgccgacttcacctgggaggtggtgaagcccctcaagttcgacaaggcatcggcttaaggttgggagtgtcactgtggacatgaggactaccttcctctggctctgctgttacctgcaagcattgctgctgctggatgtgtgtgtttgatcagtgactggctgctgctccatagaagatgaacggagagaaggatgatgaagggctttggcaatcgccgctgcaactg

SEQ ID NO: 373 - DNA, 283 bp, Zea mays
  unsure (1)..(283): unsure at all n locations
gtcttacgccatcgggtgcccgagcctctctccgtgttcgtcgacacgtacggcaccggcgcgatccccgacaaggagatnctcaagattgtcaagngaattcgatttcaggcctggcatgatcatcatcaaccttgactcaagaaaggcggcaacgggcgctactcaagacgcggcctacggcactttggaaggagacctgattcactgggagtggtgaaccatcaatggagaacttgctcnnngctattatataanttgtgcgttctgactatngttanag

SEQ ID NO: 374 - DNA, 181 bp, Zea mays
  unsure (1)..(181): unsure at all n locations
cttgccggtcccgaataaagagcanncagcgcaagagntcggtagagcgacaagaaggcaatggcggccgagagcttccttttcacctcggagtccgtgaacgaggggcaccccgacaagctgtgcgaccaggtgtcggacgccgtgcttgacgcatgcctcgcgcaggaccccgacagca

SEQ ID NO: 375 - DNA, 201 bp, Zea mays
  unsure (1)..(201): unsure at all n locations
ctgccgggtccttaataaagagcagcagcgcaaggngagccgccagcttgccccaggttggtagagcgagcgagaagaaggcaatggcggcggagagcttcctgttcacctcggagtccgtgaacgaggggcacccagacaagctgtgcgaccaggtgtcggacgcggtgctggacgcctgcctggcgcaggaccccgaca

SEQ ID NO: 376 - DNA, 216 bp, Zea mays
acatccatccccgttcgcctcttctcctccctcctgccgggtccttaataaagagcagcagcgcaagaggttggtagagcgagcgagaagaaggcaatggcggcggagagcttcctgttcacctcggagtccgtgaacgagtggcacccagacaagctgtgcgaccaggtgtcggacgcggtgctggacgcctgcctggcgcaggaccccgacagc

SEQ ID NO: 377 - DNA, 130 bp, Zea mays
  unsure (1)..(130): unsure at all n locations
gtcgaacgatgtcgggcttgacgctgaccactgcaaggtgcntgtgaacattgagcagcagtcccctgatattgcncagggtgtgcacggccacttcaccaagcgccccgaggagattngagctggtgac

SEQ ID NO: 378 - DNA, 306 bp, Zea mays
  unsure (1)..(306): unsure at all n locations
gtcggatctgagacgagacgagacgatcccccctcncctcaaccggaacttgttttaccccatctcatcccactgantccacccacccacccgcccgntgcntccgccggatntcgtcggactcggatccgcccgaccacgaccaccccgcgtcgccgccgcgcanagcagcagatcagagaagatggccggactcgacaccttcntcttcacctcggagtccgtgaacgagggacaccctgacaagctctgcgaccaggtctcagatgctgttctggaggnttgccttgctgaggaccctgacag

SEQ ID NO: 379 - DNA, 313 bp, Zea mays
  unsure (1)..(313): unsure at all n locations
gagacgagacgannnnccctcccctcaaccggaacttgttttaccccatctcatcccactgactccancnacccacccgcncgctgcctccgccggatctcgtcggactcggatccgcccgaccacgaccaccccgcgtcgccgccgcgcagagcagcagatcagagaagatggccggactcgacaccttcctcttcacctcggagtccgtgaacgagggacaccctgacaagctctggaccaggtctcagatgctgttctggacgcttgccttgctgaggacctgacagcaaggttgcttgggagacctgca

SEQ ID NO: 380 - DNA, 134 bp, Zea mays
  unsure (1)..(134): unsure at all n locations
gcngacctcanggagcacgtcatcaagcncgtgatccctgagaagtacctcgacgagangaccatcttccacctcaacccgtccgggcgcttcgtcatcggcnggccccacggtnacnccngcntcacnggtgc

SEQ ID NO: 381 - DNA, 294 bp, Zea mays
ccgggtcggatctgagacgagacgagttaccatctcatcccaactccggaacgaacaagttaccatctcatcccaactccgcctcgaccggatctcgtcggactcggatccgcccgaccaccccgcgccgccgcagatcaaagaagatggcagctgtcacacattcctcttcacctcggagtctgtgaacgagggacaccctgacaagctctgtgaccaggtctcagatgccgttcttgacgcttgccttgctgaggaccctgacagcaaggttgcttgtgagactgcaccaag

SEQ ID NO: 382 - DNA, 164 bp, Zea mays
  unsure (1)..(164): unsure at all n locations
cctgagttgatgcccctcagccatgtccttgccagcaaactaggtgctcgtntcaccgaggtccgcaagagcggaaacctgcccctggctacaggcctgatgggaagacccaggtgacagtcgagtaccgcantgagggtggtgccatggtccccatccgtntc

SEQ ID NO: 383 - DNA, 247 bp, Zea mays
  unsure (1)..(247): unsure at all n locations
cggagaaaccttctgnctaaggccgccgtnttgaggtagngnccgtngccgactttcttgnggnnnaggttgatnatgatcatgccaggcctgaaatcgaagttctccttgacaatcttgaggatctccttgtcggngatcagngccagtgcacgtacagngtcnacgaacacnganagangctcgggcactccnntnncngtaagacanctggacnatggttagtgnaagtnatnccnttgaanac

SEQ ID NO: 384 - DNA, 207 bp, Zea mays
cacgtctaatcagacattttactcagaagtcatctttgcttgccggtcccgaataaagagcagcagcgcaagaggtcggtagagcgagaagaaggcaatggcggccgagagcttccttttcacctcggagtccgtgaacgaggggcaccccgacaagctgtgcgaccaggtgtcggacgccgtgcttgacgcatgcctcgcgcagga

SEQ ID NO: 385 - DNA, 292 bp, Zea mays
  unsure (1)..(292): unsure at all n locations
gggtcggatctgagacgaggcgagacgaccccccctcccctcaaccggaacttgttttaccccatctcatcccacagnctccacccanncgcccgctgcctccgccggatctcgtcggactcggatccgcccgaccaccccgcgccgccgccgcgcagagcagcagcagatcagagaagatggccggactcgacaccttcctcttcacctcggagtccgtgaacgagggacaccctgacaagctctgcgaccaggtctcagatgctgttctggacgcttgccttgctgagga

SEQ ID NO: 386 - DNA, 142 bp, Zea mays
  unsure (1)..(142): unsure at all n locations
cgcgcgcctcaccgaggtgcgcaagaacggnncacctgcgcctggctgaggcccgacggcaagacccaggtgacggtggagtacntgaacgagggcggcgccatggtgcccgtccgcntgcacaccgtgtcatctccacaca

SEQ ID NO: 387 - DNA, 137 bp, Zea mays
  unsure (1)..(137): unsure at all n locations
gngggcgaccagggccacntgnncgggtacgccaccgacgagacccccgagctgatgcngctgagccacgngntggccaccaagntgggcgcgcgcntcaccgangngcgcaagaacggcacntggcncntggnnga

SEQ ID NO: 388 - DNA, 159 bp, Zea mays
  unsure (1)..(159): unsure at all n locations
gaaaggcggcaacgggcgctacctcaagacggcggcctacgggcactttgggaggnacgaccccgacttcacctggnaggtggtgaagcccctcaaggcggagaagccgtcttctgcatgaggcgcctcctctnttttgnaagangcttttggtcnggt

SEQ ID NO: 389 - DNA, 268 bp, Zea mays
  unsure (1)..(268): unsure at all n locations
gacgagacgagtcccctccccccacctcgcctcacccaaccggaacgaacaagttacaatctcatcccaaccccgcctcgaccggatctcgtcggactcggatccgcccgaccaccccgcgccgccgcagatcaaagaagaggcagctgtcgacacattcctcttcacctcggagtctgtgaacncgggacaccctgacaagctctgtgaccangtctcagatgccgttcttgacgcttgccttgctgaggaccctgacagcaaggtt

SEQ ID NO: 390 - DNA, 282 bp, Zea mays
aagaagggcggcaacaggttcatcaagaccgccgcctacggccacttcggccgtgacgacgccgacttcacctgggaggtggtgaagcccctcaagttcgacaaggcatcggcttaaggttgggagtgtcactgtggacatgaggactaccttcctctggctctgctgttacctgcaagcattgctgctgctggatgtgtgtgtttgatcagtgactggctgctgcttccatagaagatgaaggagagaaggatgatgaagggctttggcaatcgccgcgca

SEQ ID NO: 391 - DNA, 272 bp, Zea mays
caacgggcgctacctcaagacggcggcctacggccactttggaagggacgaccctgacttcacctgggaggtggtgaagccactcaagtcggagaaaccttctgcctaaggcggcctttttttttcagtaagaagcttttggtggtctgctgtgcttaatcatgcttttatatggcttctacatgttgtggttctttcttgatctgcaccgcgcttatcgtttgtgttgtactgccctaataagtggtgctatgaggactgtttctggtttt

SEQ ID NO: 392 - DNA, 291 bp, Zea mays
  unsure (1)..(291): unsure at all n locations
cggatctgagacgagacgagacgannnnccctcccctcaaccggaacttgttttaccccatctcatcccactgncctccngccacccacccgcncgctgcctccgccggatctcgtcggactcggatccgcccgaccacgaccaccccgcgtcgccgccgcgcagagcagcagatcagagaagatggccggactcgacaccttcctcttcacctcggagtccgtgaacgagggacaccctgacaagctctgcgaccaggtctcagatgctgttctggacgcttgccttgct

SEQ ID NO: 393 - DNA, 531 bp, Zea mays
  unsure (1)..(531): unsure at all n locations
agnnnnnnnnnatntaatgaatttnangaatgctctaccngnaattcccgggtcgacccacgcgtccgnccacncgtccgangagatcctcaagatcgngaaggagaacttcgacttcaggcccngnatgatcagcatcaacctngacctgaanaaggncggcaacaggttcatcaagaccgacgcctacagtcacttcngncgtgacgacnccgacttacctggnaggtggtgaacccctcaagttcgacaaggcatcgncttaaggctgngaagtgctcactgtggacattgaggactaccttactctggctctgntggtacctgcaaagcattggctgctgatggatgtntgngnctgatcaagngactggctgctgcttcatannagatntaccggaganaaagatgatgnataaaggcttnggcaatcggcggttcanctgnaacccatgccattccgcttanngaatggggataanttggcttggaaanaancatcattattatggnctgaactttcatctttac

SEQ ID NO: 394 - DNA, 572 bp, Zea mays
  unsure (1)..(572): unsure at all n locations
gggggnnnnggnaacttctatntcgnccgccacggtccaaaaaatcccggggtccgacccacgcgttccgaggcnacttttctcccggcaaagggacccaaaccaaagggtttgaaccncaagccgggaaccctaatnttcgcaaaggggcaanggctngcccaaagaaccaatccgtccgcccaagccgggccctttgcctccgcccgccgccaatccgttccaangattgtcttaacgccaatccgngcgttnccccgaaacctctctccgttgttcgtcgacacntacggcaccnggcgcgatccccgacaaggaanatnctcaagattgtcaaggaagaacttcnatttcaggcctgngcatgatcatcatcaaccttgacctcaagaaangcggcaacggggcgctacctcaaagacggcggcctaaggccactttgggaaagggacnaaccctgaattcaacctggggaaggttgttgaaagccaactcaaaagttccgaaaaaaanccttctggcccnaaaggcgggccctttttttcnagttaanaaaccctttggggggggnc

SEQ ID NO: 395 - DNA, 127 bp, Zea mays
  unsure (1)..(127): unsure at all n locations
cagcggccttgctcgcngcgccatcgtccaggtgtcttacgccatcggcgtgcccgatncctctctccgtgttcgtcgacacgtacggcaccggcgcgatccccgacaaggngatcctcaagattgt

SEQ ID NO: 396 - DNA, 294 bp, Zea mays
  unsure (1)..(294): unsure at all n locations
tcggnatctgagacgagacgagacgannnnccctcccctcaaccggaacttgttttaccccatctcatcccactgactccntnnancnacccgcangctgcctccgncggatctcgtcggactcggatccgcccgaccacgaccaccccgcgtcgccgccgcgcagagcagcagatcagagaagatggccggactcgacaccttcctcttcacctcggagtccgtgaacgagggacaccctgacaagctctgcgaccaggtctcagatgctgttctggacgcttgcttgctgag

SEQ ID NO: 397 - DNA, 270 bp, Zea mays
  unsure (1)..(270): unsure at all n locations
cgantnaccatctcatccncaactccggaacgaacaagttaccatctcatccanacttccgcctcgaccggatctngtcggactcggatccgcccgancaccccgnggccgccgcngatcngagaagatggcagctgtcgacacattcctcttnagctncggagtctgtgaacgagggacaccctgacaagncctgtgaccaggtctcagatgccgtcttgacgcntgcnttgctgaggaccctganagcnaaggtgcttgtganacctg

SEQ ID NO: 398 - DNA, 284 bp, Zea mays
  unsure (1)..(284): unsure at all n locations
catcaacctcgacctcaagangggcggcaacaggttcatcaagaccgccgcatacggccactttggccgtgacgacgccgacttcacctgggaggtggtcaagcccctaaagaaggcatccgcttaagaatgtattgggaagttcactggacatgaggttcatcttcgtctggctctgctgatacctgcaaggatnnnnnnnnnnnnnnnnnnnnnnngatgtgtgtttgatcagtgactggctgctctgctccatagaagatgaatgaagagagagatggtga

SEQ ID NO: 399 - DNA, 297 bp, Zea mays
  unsure (1)..(297): unsure at all n locations
atctgagacgagacgnngncnncctcncctcaaccggaacttgttttaccccatctcatcccantgantcnagnnanncacncgcncgctgcntccgncggatctcttcggactcggatccgcccgancacgaccancccgcgccgccgccgcgcagagcagcagatcagagaagatggccggactcgacaccttcntcttcacctcggagtccgtgaacgagggacaccctgacaagctctgcgaccaggtctcagatgctgttctggangttgcttgctgangacctgacagcaa

SEQ ID NO: 400 - DNA, 279 bp, Zea mays
  unsure (1)..(279): unsure at all n locations
gtcggatctgagacgagacgagacgatnncccctcccctcaaccggaacttgttttaccccatctcatcccacngactccncccacccacccgcccgctgcctccgccggatctcgtcggactcggatccgcccgaccacgaccaccccgcgtcgccgccgcgcagagcagcagatcagagaagatggccggactcgacaccttcctcttcacctcggagtccgtgaacgagggacaccctgacaagctctgcgaccaggtctcagatgctgttctgga

SEQ ID NO: 401 - DNA, 307 bp, Zea mays
  unsure (1)..(307): unsure at all n locations
cggatctgagacgagacgagacgatnnnccctcccctcaaccggaacttgttttaccccatctcatcccactgantctncccatccacccgcccgcngcctccgccggatctcgtcggactcggatccgcccgaccacgaccaccccgcgtcgccgccgcgcagagcagcagatcagagaagatggccggactcgacaccttcctcttcacctcggagtccgtgaacgagggacaccctgacaagctctgcgaccaggtctcagatgctgttctggacgttgcttgctgaggacctgacagcaaggt

SEQ ID NO: 402 - DNA, 291 bp, Zea mays
  unsure (1)..(291): unsure at all n locations
gtttgcctcttctccctcttgccggtcccgaataaagagcagcagcgcaagaggtacggtagagcgagaagaaggcaatggcggncgagagcttccttttcacctcggagtccgtgaacgangggcaccccgacaagctgtgcgaccaggtttacaaaanccgtgcttgacgcatgcctcgcgcagaccccgacagcaaggtggcttncgagacttncaccaagaccacatggtangttttngnngntggnncgncaaagnnaangngtttnanaaaaatntnnnnanccc

SEQ ID NO: 403 - DNA, 386 bp, Zea mays
  unsure (1)..(386): unsure at all n locations
caagaaagncggcaacgggccgctacctcaagacgggggcgnacggccactttggaagggacgaccctgacttcacctgggaggtggtgaagccactcaagtcggagaaaccttctgcctaaggcggccttttttttcagtaagaagcttttggtggtctgctgtgcttaatcatgcttttatatggcttctacatgttgtggttctntcttgatctgcaccgngcttatcgnntnngttgtactgncctaataaatnngtgcttatgangacttgttnntggntnnnntantanngttnnaatgctttaaaacaatgantgaattncaagccannntttttttgagaagtaannattattngntaannngntnngnntntnnngg

SEQ ID NO: 404 - DNA, 144 bp, Zea mays
  unsure (1)..(144): unsure at all n locations
tccgtgttcgtcgacacgtacggcaccggcgcgatccccgacaaggagatcctcaagattgtcaaggagaacttcgatttcaggcctggcatncatcatcatcaaccttgacctcaagaaaggcggcaacgggcgctacctcaa

SEQ ID NO: 405 - DNA, 293 bp, Zea mays
agaacttcgacttcaggcccgggatgatcagcatcaacctcgacctgaagaagggcggcaacaggttcatcaagaccgccgcctacggccacttcggccgtgaacgacgccgacttcacctgggaggtggtgaagcccctcaagttcgacaaggcatcggcttaaggttgggagtgtcactgtggacatgaggactaccttcctctggctctgctgttacctgcaagcattgctgctgctggatgtgtgtgtttgatcagtgactggctgctgtccatagaagatgaacggag

SEQ ID NO: 406 - DNA, 175 bp, Zea mays
  unsure (1)..(175): unsure at all n locations
ggtcaccatcaacctcgacctcaagaagggcggcaacaggttcatcaagaccgccgcatacggccatttggncgtgacgacgccgacttcacctgggaggtggtcaagcccctaaagaaggcatccgcttaagaatgtattgggaagttcactggacatgaggttcatcttcgtc

SEQ ID NO: 407 - DNA, 219 bp, Zea mays
  unsure (1)..(219): unsure at all n locations
agggtgtgcacggccacttcaccaagcgccccgaggagattggagctggtgaccaggggcacatgtttgggntgcgactgacgagacccctgagtgatgccctcagccatgtcttgccaccaagctggtgtcgtctcacggagtnccaagatggactgccctgntcagccgtggaagaccagtgcagtgatacgnagaggtggcatgtccacggtnnnc

SEQ ID NO: 408 - DNA, 178 bp, Zea mays
  unsure (1)..(178): unsure at all n locations
gccagggatgatcaccatcaacctcgacctcaagangggcggcaacaggttcatcaagaccgccgcatacggccactttggctgaacgacgccgacttcacctgggaggtggtcaagcccctaaagaaggcatccgcttaagaatgtattgggaagttcactggacatgaggttcatc

SEQ ID NO: 409 - DNA, 126 bp, Zea mays
  unsure (1)..(126): unsure at all n locations
gcaatggcggcggagagcttcctgttcacctcggagtccgtgaacgaggggcacccagncaagctgttcgancaggtgtctgangcggtctggangccttcctgnntcaggancccgacantaaag

SEQ ID NO: 410 - DNA, 132 bp, Zea mays
  unsure (1)..(132): unsure at all n locations
gacctcaagangggcggcaacaggttcatcaagaccgccgcatacggccactttggccgtgacgacgccgacttcacctgggaggtggtcaagcccctaaagaaggcatccgcttaagaatgtattgggaag

SEQ ID NO: 411 - DNA, 83 bp, Zea mays
  unsure (1)..(83): unsure at all n locations
gtcggangcggtgctggangcctgcctggngcaggannccganagcaaggtggcctgcgaganctgcaccaagangaacatgg

SEQ ID NO: 412 - DNA, 133 bp, Zea mays
  unsure (1)..(133): unsure at all n locations
gcctcgaccggatctcgtcggactcggatccgcccgaccaccccgcgccgccgcagatcaaagaagatggcagctgtcgacacattcctcttcacctcggagtctgtgaangaggganaccctgacaagctct

SEQ ID NO: 413 - DNA, 290 bp, Zea mays
  unsure (1)..(290): unsure at all n locations
tcggatctgagacgagacgagacggnnnnccctcccctcaaccggaacttgttttaccccatctcatcccagtgantcntaccacncanccgcgcgcngcntccgcnggatctngtcggactcggatccgcccgaccacgaccaccccgcgtcgccgccgcgcagagcagcagatcagagaagatggccggactcgacaccttcctcttcacctcggagtccgtgaacgagggacaccctgacaagtctgcgaccaggtctcagatgtgtttggacgttgnttgctgagg

SEQ ID NO: 414 - DNA, 310 bp, Zea mays
  unsure (1)..(310): unsure at all n locations
aacaggttcatcaagaccgccgcatacggccactttggccgtgacgacgccgacttcacctgggaggtggtcaagcccctaaagaaggcatccgcttaagaatgtattgggaagttcactggacatgaggttcatcttcgtctggctctgctgatacctgcaaggatnnnnnnnnnnnnnnnnnnnnnnngatgtgtgtttgatcagtgactggctgctctgctccatagaagatgaatgaagagagagatggtgaagaaggctttggcaaatggcaattgccgcagcaagccatgtcggcgccactgac

SEQ ID NO: 415 - DNA, 85 bp, Zea mays
ctcagggtgtgcatggccacttcaccaagcgccccgaggagattggagctggtgaccagggacacatgttcgggtatgcgaccga

SEQ ID NO: 416 - DNA, 166 bp, Zea mays
  unsure (1)..(166): unsure at all n locations
gagcagcagcgcaaggnganccgccagcttgccccaggttggtagancgagcnagaagaaggcaatnncggcggagagttcctgttcacntcggagtccgtgaacgangggcacccagacaagctgtgcgaccaggtntcggacgcggtgctggacncctgcntgg

SEQ ID NO: 417 - DNA, 267 bp, Zea mays
  unsure (1)..(267): unsure at all n locations
aagacggcggcctatggccactttggaagggacgaccctgacttcacctgggaggtggtgaagccactgcaagtcggagaaaccttctgcctaaggcggccttttttttcagtaagaagcttttggtggtctgctgtgcttaatcatgcttttatanggcttctacatgttgtggttctttcttgatctgcaccgcgcttatcgtttgtgttgtactgccctaataagtggtgcttatgaggactgtttctggttttgctgcttatg

SEQ ID NO: 418 - DNA, 273 bp, Zea mays
acgaccccgacttcacctgggaggtggtgaagcccctcaaggcggagaagccgtcttctgcatgaggcgcctcctctgttttggaagaagcttttggtctggtctggtctggtctggtgtgcctgcgctctatcatgcttttttatggctcctacttgtgattcttgatctgccccttgcttatcatttgtactgtactgtcactgtcctaataagtggtacgtgtgcggggtcgtattgtgtctgcttattcacctagaggattatttctgg

SEQ ID NO: 419 - DNA, 57 bp, Zea mays
atcgctgctgacctgaaggagcatgtcatcaagcctgtcatccctgagcagtacctt

SEQ ID NO: 420 - DNA, 235 bp, Zea mays
  unsure (1)..(235): unsure at all n locations
gtcggatctgagacgagacgnngnnnccctcccctcaaccggaacttgttttaccccatctcatcccactgactcngnccacccaccannncantgcctccgccggatctcgtcggactcggatccgcccgaccacgaccaccccgcgccgccgccgcgcacagcagcagatcagagaagatggccggactcgacaccttcctcttcacctcggagtccgtgaacgagggacacc

SEQ ID NO: 421 - DNA, 297 bp, Zea mays
  unsure (1)..(297): unsure at all n locations
gccaagggatgatcaacaatccaacntcganctccaagaangggcggnaacaggttcatcaagaccgccgcatacggccactttggccgtgaacgacgccgacttcacctgggaggtggtcaagcccctaaagaaggcatccgttaagaatgtattgggaagttcactggacatgaggttcatcttcgtctggctctgctgatacctgcaaggatnnnnnnnnnnnnnnnnnnnnnnngattgtgtttgatcagtgactggctgctctgctccatagaagatgaatgaagagagaga

SEQ ID NO: 422 - DNA, 88 bp, Zea mays
  unsure (1)..(88): unsure at all n locations
cacncacgagaccgtcaccaacgacgagatcgccgccgacctcaaggagcacgtcatcaagcccgtgatccctgagaagtacctgcga

SEQ ID NO: 423 - DNA, 285 bp, Zea mays
  unsure (1)..(285): unsure at all n locations
ccgggtcggatctgagacgagacgagttaccatctcatcccaactccggaacgaacaagttaccatctcatcccaactccgcctcgaccggatctcgtcggactcggatccgcccgaccaccccgcgcngccgcagatcaaagaagatggcntcgtcgacacattcctcttcacctcggagtctgtgaacgagggacaccctgacaagtctgtgaccaggtctcagatgccgttcttgagcttgcnttgctgaggaccctgacagcaaggttgttgtgagactgc

SEQ ID NO: 424 - DNA, 136 bp, Zea mays
  unsure (1)..(136): unsure at all n locations
accacgaccaccccgcgtcgccgccgcgcanagcagcagatcagagnagatagccggatctcgacaccntcctcttcacctcggagtccgtgaacgagggacaccctgacaagctctgcgaccaggtctcagatgc

SEQ ID NO: 425 - DNA, 217 bp, Zea mays
  unsure (1)..(217): unsure at all n locations
cgagacgagtnncctccccccacctcgcctcacccaaccggaacgaacaagttacaatactcatcccaaccccgccttcgaccggatctcgtcggactcggatccgcccgaccaccccgcgccgccgcagatcaaagaagatggcagctgtcgacacattcctcttcacctcggagtctgtgaacgagggacaccctgacaagctctgtgaccaggt

SEQ ID NO: 426 - DNA, 231 bp, Zea mays
cggatctgagacgagacgagttaccatctcatcccaactccggaacgaacaagttaccatctcatcccaactccgcctcgaccggatctcgtcggactcggatccgcccgaccaccccgcgccgccgcagatcaaagaagatggcagctgtcgacacattcctcttcacctcggagtctgtgaacgagggacacctgacaagctctgtgaccaggctcaatgccgttcttg

SEQ ID NO: 427 - DNA, 85 bp, Zea mays
  unsure (1)..(85): unsure at all n locations
agtacctcgangagaagaccatcttccacctcaacccgtccgggcgcttcgtcatcggnnggntcganggtgacgtnggcctcat

SEQ ID NO: 428 - DNA, 142 bp, Zea mays
caaccccgcctcgaccggatctcgtcggactcggatccgcccgaccaccccgcgccgccgcagatcaaagaagatggcagctgtcgacacattcctcttcacctcggagtctgtgaacgagggacaccctgacaagctctgt

SEQ ID NO: 429 - DNA, 151 bp, Zea mays
cgttcgcctcttctcctccctcctgccgggtccttaataaagagcagcagcgcaagaggttggtagagcgagcgagaagaaggcaatggcggcgagagcttcctgttcacctcggagtcggtgaacgaggggcacccagacaagctgtgcg

SEQ ID NO: 430 - DNA, 257 bp, Zea mays
  unsure (1)..(257): unsure at all n locations
agtgctcctcctcctatgaagaaggactctccacgttctcnccgtcaaagcagtggaaaacagatttgggcgaggtagcaacagcgtcttcagcagcgcagaagctctggtatacgaggagcccgcctccaggcagctcctgctccaccatgttgttgcagtcatagaccaaatctgttttccactgctttgacggcgagaantggannagtgctcctcctcctatgaagaaggactacaaactagctaatcttctc

SEQ ID NO: 431 - DNA, 220 bp, Zea mays
aaagagatgacgaagctctcggggattcatgagatcattcccgagatggagatctgtgactttgagtttgacccctgtgggtactcgatgaatggcgtcttcgggcctgcagcctccaccatccacgtgacacccgaggaaggtttcagctacgcaagctacgaagctatgaacttcgaccccagctcactggtctacagcgatgtgatcaggagggtcc

SEQ ID NO: 432 - DNA, 240 bp, Zea mays
  unsure (1)..(240): unsure at all n locations
gggagaaattcgtgagatcttggnncgtntcagggcgtgcgagcnctggaatcatgggtttcacacatagcttcgnctnttngaatttnatgtactaatggagtcnaagggtggcaaaaagtcnnncngtagtcgttctatggtgtatgaagcgccccttggctacagcattgaggncgttcgacctgccggagcgtgaagaantccagctgcggcttactcgaactgcgngaatnagcg

SEQ ID NO: 433 - DNA, 263 bp, Zea mays
  unsure (1)..(263): unsure at all n locations
cttgtgtcggtagttttccgttggctctggctgccttcctctgcttctgagattccaacttgtcttgcccatctctccttttcctctctcatcctctctttcttgcaacacgtcatccagtggcgatgtcttcagcagattcttgtgtctcttctcctgcctcccctattggctttgagggctatgagaagcgcctcgagatcacgttctctgacgcgcctgtctttgaggacccttgtggtcgtggcntgcgcgccctctcc

SEQ ID NO: 434 - DNA, 290 bp, Zea mays
  unsure (1)..(290): unsure at all n locations
taatgctgatggcaacacaacattagtcttgaagaagaatgaagctttcttcaagactaatgctgatggcaacacaacatanttccaaggaaatgacgaagctctctggtatctctgaaattatccctgagaaggagatctgtgattttgacttcgaaccctgcggctactccatgaatgcaatccatggctctgcgttctccacgatccatgtgacgcctgaggatgggttcagctacgccagttatgaggttatgggcttggatgccactgccctgtcttacggtgac

SEQ ID NO: 435 - DNA, 258 bp, Zea mays
  unsure (1)..(258): unsure at all n locations
tggagcaggagctgcctggaggcgggctcctcgtgtaccatngcttctgtgntgctgaagacgctgttgctacctcgcccaaatctgttttccacngcnttganggcgagaacgtggagagtgctcctcntcgnntgaggagganancaagnggnnaangttctntgttgggagnatnanacgggntgccatggaggaganggcgggattccttgatgagtaatanggggctctgggntcgattagcttctgattgtt

SEQ ID NO: 436 - DNA, 263 bp, Zea mays
cttgctctaaaacaatcgcagtcctgcaagttgttgctgctgctcctacccctgcctctgcaattgggtttgagggatatgagaagcgcctcgagatcagcttctatgaggcacctgtcttcgctgaccccaacggaaggggattgtgtgcactcttgcgtccctagatttactctatttctgaccatgcacggtgcaccgttgtctctgagctatcaaacgaggactttgactctatgtcttatctgagtcaagcctgtttg

SEQ ID NO: 437 - DNA, 266 bp, Zea mays
  unsure (1)..(266): unsure at all n locations
cccaganatggagatctgtgacttcgacttcnagccctgtggctactccatgacatgctgttcatggcnctgcnattgtcgaccattcatgngancccncaggacgggcatcagctaatgaaagcaacanggncatgggcnttaanccggggctcctttctcatatggtnanctggntaaganggtgctgaagnnntttngnccnactgantncnctgttgncgtaacccatcttccggtgatcgggcaatgcgaagacctggggg

SEQ ID NO: 438 - DNA, 281 bp, Zea mays
gggctgcccggtgtaggcaagtcaaccatcatgagcgagctttattaatatgatgcaagctacctggtttggtggtaatgcttatgtgattggtgattctgcaaagcataagcagaagtggcacgtctactatgccaccactgagcacccctgaggagcttgttgttactcttgagatgtgcatgactaggctggacaagaagagagcttatgtcttcttcaagacctctattgatggttacacatcttgtgctaaggatatgaccaagccttcagtgatt

SEQ ID NO: 439 - DNA, 334 bp, Zea mays
gcagaagtggcacgtctactatgccaccactgagcacccctaaggagcttgttgttactcttgagatgtgcatgactaggctggacaagaagagagctatgtcttcttcaagacctctattgatggttacacatcttgtgctaaggatatgaccaagccttcagtggcatcgtcaaggagtgcgtcgtgaccagtggtgctagcagcaaggccatggcactcagggtccatgggtcgtgggtgtggcttgttcagcgcctactattcgcgggagtcggcgaggtgcctgctgaacttggtggaagtggagtccattatgatctgacacgacctc

SEQ ID NO: 440 - DNA, 349 bp, Zea mays
  unsure (1)..(349): unsure at all n locations
catctatcctctgaagattgtcatcaagacctgtggcactaccaagctcctgctcacaattccaaggatcctagagcttgtgaagagctgtctatgctcttgtgctgtgaantatcccgcgggacgttcatctttcctggcgnacagcagccccccaccggagttctccgaggagttgtgtattaaccgtactttgggggctgaagtctggtggcatgcttatgtgattggagatgcagcaagaccaggacagaagtggcacatctatacgccactgagtacccagagcaaccatgtcaccttgagatgtgcatgatggttggacagaagaagcttcatcttcttcaag

SEQ ID NO: 441 - DNA, 260 bp, Zea mays
  unsure (1)..(260): unsure at all n locations
tttctcttatggngacctggntaagagggtgctgaggcgcttnggtccaactgagcnctctgttgccgtgaccatcttcggtgatcgggacaatgcgaagacctgggggacgaaactgnatgctgaggcctatgcttgcagcaacatggctgagcaggagcttgccgattggtggcttgctcatctatcagagcttcactgttacggccgaancgacctntgnttcccagngcaaacntcgnaaattccgggnaaantaa

SEQ ID NO: 442 - DNA, 447 bp, Zea mays
  unsure (1)..(447): unsure at all n locations
cgtccctgcacacggcggttttcagactgcgatccattccgagcttcgaggaatcgatggtcnagcttcggtgactaagagatcaaactcttcaagttctacgaggctgaagatcctgagcatctgtttggtgaagattcttatgccatggaaattcatcgattgataccgtccttttcatagtcgatcatggttcaaggagattgcatttgtggatgctctaatggagtcgaaaggtggtaagaaagtcnnnnnnnnnnnnnnnnnnnttcatgtacgaagctccccttggctacaagatcgaggacgttcgcccagccggaggaatcaagaagttccagactgctgcttattccaactgcgtccgccagccatcctgatatcgcctcacatgcaattcgcggtagagtaggattttaattcagttttcctcttgngtcngnaggt

SEQ ID NO: 443 - DNA, 192 bp, Zea mays
  unsure (1)..(192): unsure at all n locations
gggctgagacttcgannacgagccctnttgctattncatgaatgctgnaaatnanccggggttgggganaattcatntgagncnagaggacngattnagctatgcaagctannaggtcatgggctngaacccggactctttntgttatggtgacctgcctaanagggagctgangngctnnggtccaaatga

SEQ ID NO: 444 - DNA, 376 bp, Zea mays
  unsure (1)..(376): unsure at all n locations
caaagctnntgctcgctattccgaggntccttgnactngntgaanagctccngttgcnactcgctgcagttaaanactnncgtggaacgtncatattccntgaagcacanccnttcnnacacaagaacttngntgacgaggttgccttcctgaatngcttattcngtggnctnaagtncngnngcaatgcttatgtgantggtgactctgccaancccggncagaagtgncacgtctactacacnnctgagcaccctgangagcctgtnngnactctggagatgtgcatgactgggctggacaagancaaagcttcatgncntcttcaagaccactgnntgatggttactcgctnatncgccaaggatatcaccaa

SEQ ID NO: 445 - DNA, 502 bp, Zea mays
  unsure (1)..(502): unsure at all n locations
gtgctagtggcnangnnntnnngtatnaangacacactccggtncggaattcccgggtcgacccacgcgtccgcggacgcgtggggttgccaaagaattncctnccctaccgtcgtcgncgctcgtctggnngggaagttccnggacccnngatttngcccaattctnaggnaaaaanncggtttacntnncttaacccngggnnttctncctntngtngttgttaaaggganaaaattntnagatctgttccggatcaagcgtgcganctcgggaatcaagggttttnacacatatcttttccatttgaaaattgatntactaaatggngtctanaaggtggcaaaaagtctnacaatagtcgttctatnatgtatgaagctccccttngctncagcattnaggacgttcgacctgcccgangcctnaagaaatttccagtctnctgcttactncaacttcncnaaaaaaccattctgatatccttttgcttnctcaatnt

SEQ ID NO: 446 - DNA, 160 bp, Zea mays
  unsure (1)..(160): unsure at all n locations
agtngctgcacttaaccgttnctttggcggcctgaaatctggtggnangggcgggtgtgatnggagatccagcaagacctggncagaagtggcacttnttnnaacgncantnantnccnattancaaccaatggttaacctanaaatgtgcatnactgna

SEQ ID NO: 447 - DNA, 487 bp, Zea mays
  unsure (1)..(487): unsure at all n locations
attacgtccnctagcccttcgccnncgctcttttccntnagaggcgccggcaccgangatccgggncgggntcnatntnnagaannggnagtacttgtctcagcccggggnctgctgcgtcnggtggtggtnaaggggagaanntcgtnagatctgntccggatcaagcgnncganctcgggaatcaggggtttcacacatanctgngncgatcncgaattctgatgtactaatggagtctaagggnggcaaaaagtctagccttacntacnctatnatgcatagaagctccccttggctacagcattnacgaccgttcganctgtccngaggcgtgaaaaagntccnntacngctgcttactccaacttgcgcgaaacaanccntcctgaanantccccttttggcttcctcattctaagcactttaaggaattttaatntctggacacttntggantnttnaccaaanctcntctgggcctaggg

SEQ ID NO: 448 - DNA, 438 bp, Zea mays
  unsure (1)..(438): unsure at all n locations
gagganntcgttgagatctaagatagagaatcgctggggcangngnctgtggtctgctgcgtagggtggtgntgaangggagaagtttaagatctgntccacagatcacgcgtgcgcgctcgcgaancgggggttccacacatagcttngtcggtttgaatttgangtactaatggagtctaagggtggcaagaantctagcagnagtcgttccatgatgnatgaagctccccttggctacagcattgaagacgttcgacctgccggaagcgccaaagaagttncagncttgntgcttaactccaactggcncaaaagaanccatnctgnaatcccctttggnttccccgntctangagnttaagaattcttttcttgcactttnaatcttaacnaatccccctgggctgangntttnctgacaaangaaccaattnc

SEQ ID NO: 449 - DNA, 429 bp, Zea mays
  unsure (1)..(429): unsure at all n locations
ctcgattacaaactgtgtactatgttaatgtaatgacatagtttggntgatacagatcgtagtgatgttgtttgaagctgtttgtatnaactgtntcctactatcttgtatgaattatgatgtctgatgtagtntgtatgaactatgtcatattatgttgaatgaagctattgcatgcccttaaaaaanaaaaaccnaagannanaatgatctactccaantaacgagnttatgggcttggatgccactgntntgnnttatggtgaccttgtcaagagggtgctnctgnnctttngccnntnagagttttacnttgccttgaccatcttcnncggncgtggnatgccgggacatnnggnaaggnacttggtgnanaagtctttnactgnnacancntgttcgaacangacttntnttnaagcggnctcc

SEQ ID NO: 450 - DNA, 376 bp, Zea mays
  unsure (1)..(376): unsure at all n locations
ccaatatctttactnccgcccctgcncgtaattccctnctggccncacgcatccngctgaagacnctntntnctacctcncccnantntgttttccactnctttnaccacgagggnggggnagattgctcctnctnctatcaataangactacaatctggctaatcttctctgctnaacangaggaatccccatgccatnnatnaccaagncnntagtgcttgatnantaataccntcttctaagntccatntncttctgaattgnntatantatatcctcacantttcatanttntcantnagttattctatcaagcatccaatccattctattgtatattaaaatttntctctctntatncatgtcaacttcct

SEQ ID NO: 451 - DNA, 305 bp, Zea mays
  unsure (1)..(305): unsure at all n locations
ggaagttggatgctatcgaggagaaggatggagtgcttgatgagtaagacgggtttctggtgtcgatttgcttctgagtttttttctnttttatatcgttgcgatctcgtggttgtcgtttggttagcagccaagccaggctattagtacgaagaatgtcgtctataaacatgtgttcctacgttgccacatgctgagtcaatctgtatacagctagctctaggtggtcagctgcgtctaccacaatgagcatacatgtatggataaatcttctgtgaaagcattcgatgaataagggttgtttt

SEQ ID NO: 452 - DNA, 276 bp, Zea mays
  unsure (1)..(276): unsure at all n locations
atgcaagcaccttttgcgaaggactgcaagctggctaatcttgtctgcttggaggaagttggatgctatcgaggagaaggatggagtgcttgatgagtaagacgggtttctggctcgatttgcttctgagtttttttctttttatatcgttgcgatctcgtggatgtcgtttggttagcagccaagccaggctattagtacgaagaatgtcgctataaacatgtgttcctacgtgccacatgctgagtcaatctgtatacagctantctaggtggc

SEQ ID NO: 453 - DNA, 501 bp, Zea mays
  unsure (1)..(501): unsure at all n locations
gnaagngttttgaatgggggntggggngnaannnnnnnctngtaccggtcggngngtcgncccacgcntacgcgccnttgntagctcggcccaaatccgttcttngntgctttgatggcgagaatgcagcaccttttgcgaaggactgcaagctggctaatcttgtctgcttggaggaagttggatgctatcgaggagaaggatggagtgcttgatgagtaagacgggtttctggtgtcgatttgcttctgagtttttttctttttatatcgttgcgatctcgtgggttgtcggtttggttagcaagccaagccaggctattagtaccaaagaatgtcgnctataaacatgtgttcctacgttgcacatcctgagtcnaatctgtattncagctagctctaaggtgggtcagcttgcgtctaccacaatgagcataccatgtatggataaatcttctgtgaaagcattcgatgaataagggttgttttcaaaaaaaaaaaa

SEQ ID NO: 454 - DNA, 247 bp, Zea mays
  unsure (1)..(247): unsure at all n locations
gtgtcgatttgcttctgagttntcttctttttatatcgttgcgatctcgtggttgtcgtttggttagcagccaagccaggctattagtacgaagaatgtcgtctataaacatgtgttcctacgttgccacatgctgagtcaatctgtatacagctagctctaggtggtcagctgcgtctaccacaatgagcatacatgtatggtaaatcttctgtgaaagcatcgntgaataaggtngtttcgtntt

SEQ ID NO: 455 - DNA, 185 bp, Zea mays
gtttggttaagcagccaagccaggctattagtacgaagaatgtcgtctataaacatgtgttcctacgttgccacatgctgagtcaatctgtatacagctagctctaggtggtcagctgcgtctaccacaatgagcatacatgtatggataaatcttctgtgaaagcattcgatgaataagggttg

SEQ ID NO: 456 - DNA, 148 bp, Zea mays
  unsure (1)..(148): unsure at all n locations
gtcgtctataaacatgtgtncctacgttgccacatgctgagtcaatctgtatacagctagctctaggtggtcagctgcgtctaccacaatgagcatacatgtatggataaatcttctgtgaaagcattcgatgaataagggttgtttt

SEQ ID NO: 457 - DNA, 109 bp, Zea mays
ctgtatacagctagctctaggtggtcagctgcgtctaccacaatgagcatacatgtatggataaatcttctgtgaaagcattcgatgaataagggttgttttcgtgatt

SEQ ID NO: 458 - DNA, 249 bp, Zea mays
cttcgggcctgcagcctccaccatccacgtgacacccgaggaaggtttcagctacgcaagctacgaagctatgaacttcgaccccagctcactggtctacagcgatgtgatcaggagggtcctggcaggcttctctccttcggacttctcggtcgcagttaccatctttggtggccgtgggttcgccaaatcatgggcgacgggtgcagacatcgattcctacatgtgcggtgatcctgtagagcaaga

SEQ ID NO: 459 - DNA, 338 bp, Zea mays
  unsure (1)..(338): unsure at all n locations
cgaantatgaacttcgaccccagctcactggtctacagcgatgtgatcaggagggtcctggcaggcttctctccttcggacttctcggtcgcagttaccatctttggtggccgtggggttcgccaaatcatgggcgacgggtgcagacatcgattcctacatgtgcggtgatcctgtagagcaagagcttcctggtggcggtctgctgatgtaccagagctttactgctgttccctctggctctgtatcgccgaggtcgaccttgcagacggatggctggagcagcgatggaatggagatggcctcaaatgacgagatgtgtattggctgctggaatg

SEQ ID NO: 460 - DNA, 165 bp, Zea mays
  unsure (1)..(165): unsure at all n locations
cggncttctcggtcgcagttaccatctttggtggccgtgggttcgccaaatcatgggcgacgggtgcagacatcgattcctacatgtgcggtgatcctgtagagcaagagcttcctggtggcggtctgctgatgtaccagagctttactgctgttccctctggct

SEQ ID NO: 461 - DNA, 293 bp, Zea mays
  unsure (1)..(293): unsure at all n locations
agccgccctacctattccttctcccagccgtcgagctgcccaacccagagcaccagcagccctcaccttcttcctctcggccggtccttcaaacgagcccgctcgtcttggagccgccgccggtctcgttctggacgaacgttcaaggagattgcatttgtggatgctctaatggagtcgaaaggtggcaagaagtcnnnnnnnnnnnnnnnnnnnttcatgtacgaagctccccttggctacaagatcgaggacgttcgcccagccggangaatcaagaagttccagactgc

SEQ ID NO: 462 - DNA, 289 bp, Zea mays
  unsure (1)..(289): unsure at all n locations
gacctattccttctcccagccgtcgagctgcccaacccagagcaccagcagccctacaccttcttcctctacggccggtccttcaaacgagcccgctcgtacttggagccgccgccggtactcgttctggacgaacgttcaaggagattgcatttgtggatgctctaatggagtcgaaaggtggcaagaagtcnnnnnnnnnnnnnnnnnnnttcatgtacgaagctccccttggctacaagatcgaggacgttcgcccagccggagaatcaagcagttccgactgatg

SEQ ID NO: 463 - DNA, 264 bp, Zea mays
  unsure (1)..(264): unsure at all n locations
attccttctcccagccgtcgagctgcccaacccagagcaccagcagccctcaccttcttcctctcggccggtccttcaaacgagcccgctcgtcttggagccgccgccggtctcgttctggacgaacgttcaaggagattgcatttgtggatgctctaatggagtcgaaaggtggcaagaagtcnnnnnnnnnnnnnnnnnnnttcatgtacgaagctccccttggctacaagatcgaggacgttcgcccagccggaggaatca

SEQ ID NO: 464 - DNA, 571 bp, Zea mays
  unsure (1)..(571): unsure at all n locations
gnnatagtataangaaaggngnagnatntnntatacnngtccggaattcccgggtcgacccacgcgtccggtccggtggcaatgcttatgtgattggtgactctgcgaagcccgggcagaagtggcacgtntactacgccgctgagcaccctgaggagcctgtcgttactctggagatgtgcatgactgggctggacaagaagaaagcttctgtcttcttcaagaccactgctgatggttactcgctgtgcgccaaggagatgaccaagctctctggtatctcggacatcatcccagagatggagatctgtgacttcgacttcgagccctgtggctactccatgaatgctgttcatggccctgctttgtcgaccattcatgtgaccccagaggacggcttcagctatgcaagctacgaggtcatgggcttnaacccgggctctttctcttatggngacctggttaaaaagggtctnaagtnctttggtcaactgaattctntggtgccgtgaccatnttngngaannggacaaatgcnaaaaccttggggaccaaactggattcttaaggc

SEQ ID NO: 465 - DNA, 522 bp, Zea mays
  unsure (1)..(522): unsure at all n locations
agagggctcgnngttnganaggngnnnnaggnantttttgnaattccgaattcccgggtngacccacgcgtccgctnatgtcttatctgagtcgagcctgtttgtctacccgtacaagattgtgatcaagnggtgtggaagtacaaagcttctgctcgctattccgaggatccttgaacttgctgaagagctcctgttgccactcgctgcagttaaatactcccgtggaacgttcatattccctgaagcacaaccttccccacacaagaacttcgctgacgaggttgccttcctgaatcgcttcttcggtggcctcaagtccggtggcaatgcttatgtgattggtgactctgcgaagcccgggcagaagtggcacgtctactacgccgctgagcaccctgaggagcctgttgttactctagagatgtgcatgactgggctggacaagaagaaagcttctgtcttcttcaagaccactgctgatggttactcgctgtgcgccaaggagatgaccaactctct

SEQ ID NO: 466 - DNA, 515 bp, Zea mays
  unsure (1)..(515): unsure at all n locations
gagnttgnttcnacgnaggggggatntaacggaaangcttgtaccggtccggaattcccgggtcgacccacgcgtccgattccctgaagcacagccttccccacacaagaacttcgctgacgaggttgcctncctgaatcgcttcttcggtggcctcaagtccggtggcaatgcttatgtgattggtgactctgcgaagcccgggcagaagtggcacgtctactacgccgctgagcaccctgaggagcctgttgttactctagagatgtgcatgactgggctggacaagaagaaagcttctgtcttcttcaagaccactgctgatggttactcgctgtgcgccaaggagatgaccaagctctctggtatctcggacatcatcccagagatggagatctgtgacttcgacttcgagccctgtggctactccatgaatgctggtcatggcctgcttggcgaccattcatgtgaccccaanaggacggtttagctttgcaagctacnaggcatggctt

SEQ ID NO: 467 - DNA, 531 bp, Zea mays
  unsure (1)..(531): unsure at all n locations
gngagggntntgtntgggggggggnaggaaanttgtnncctccggaattcccgggtcgacccangcgtccggtcttcctcccgtggcctgtctgtcatctggctctgaaacgatggcagtcctgcaagttgctgctggtgcccctccccctgtctctgtgattgggttcgagggatttgagaagcgccttgagatcagcttctctgaggcacctgtcttggctgaccccagcggaaggggactgcgtgcgctctcgcgtgcccagatcgactctgttcttgaccttgctcggtgcaccattgtgtccgagctctcaaacgaggacttcgactcttatgtcttatctgagtcgagcctgtttgtctacccatacaagattgtgatcaagacctgtggaactacaaagcttctgctcgctattccgaggatccttgaacttgctgaagagctcctgttgccactcgctgcaagttaaatactcccgtggaacgttcatattccctgaagcacaaccttcccacacaagaactt

SEQ ID NO: 468 - DNA, 463 bp, Zea mays
  unsure (1)..(463): unsure at all n locations
caaagaccacttcccgtcttcctccngtggnctgtctgtcatctggctctgaaacgatggcagtcctgcaagttgctgctgctgcccctccccctgtctctgtgattgggttcgagggatttgagaagcgccttgagatcagcttctctgaggcacctgtcttggctgaccccagcggaaggggactgcgtgcgctctcgcgtgcccagatcgactctgttcttgaccttgctcggtgcaccattgtgtccgagctctnaaacgaggacttcgactcttatgtcttatctgagtcgagcctgtttgtctacccatacaagattgtgatcaagacctgtggaactacaaagcttctgctcgctattcccgaggatccttgaacttgctgaagagctcctgttgccactcgctgcagttaaatacttccgtggaacggtcatattcctgaacacaagccttccca

SEQ ID NO: 469 - DNA, 474 bp, Zea mays
  unsure (1)..(474): unsure at all n locations
ggnnnnnnngnaaactttatccgncagntaccggtcaaagaantcccgggtcgacccaccgtccgcccacgcgtccgcccacgcgtccgctgatggttactcgctgtgcgccaaggagtgaccaagctctctggtatctcggacatcatcccagagatggagatctgtgacttcgactcgagccctgtggctactccatgaatgctgttcatggccctgctttgtcgaccattcattgaccccagaggacggcttcagctatgcaagctacgaggtcatgggctttaacccgggcctttctcttatggtgacctggttaagagggtgctgaggtgctttggtccaactgagtttctgttgccgtgaccatcttcggtgatcgggacaatgcgaagacctgggggacgaaactgatgctgaggcctatgcttgcaagcaacatggttgagcaagtgctgccgtttggtggcttcc

SEQ ID NO: 470 - DNA, 304 bp, Zea mays
ctgtcttcttcaagaccactgctgatggttactcgctgtgcgccaaggagatgaccaagctctctggtatctcggacatcatcccagagatggagatctgtgacttcgacttcgagccctgtggctactccatgaatgctgttcatggccctgctttgtcgaccattcatgtgaccccagaggacggcttcagctatgcaagctacgaggtcatgggctttaacccgggctctttctcttatggtgacctggttaagagggtgctgaggtgctttggtccaactgagttctctgttgccgtgac

SEQ ID NO: 471 - DNA, 450 bp, Zea mays
  unsure (1)..(450): unsure at all n locations
ctgtgacttcgacttcgagccctgtggctactccatgaatgctgttcatggccctgctttgtcgaccattcatgtgaccccagaggacggcttcagctatgcaagctacgaggtcatgggcttcaacccgggctctttctcttatggtgacctggttaagagggtgctgaggtgctttggtccaactgagttctctgttgccgtgaccatcttcggtgatcgggacaatgcgaagacctgggggacgaaactggatgctgaggcctatgcttgcagcaacatggttgagcaggtgctgccgtttggtggcttgctcatctatcagaagcttnactgttacgggccgaaacgaacccatgggtcgccgaaggtcaagtcctgcatgaacttcgctggtgacattgtcaagaaatngnttaaaagagtgatgctccctgggaagctgatctg

SEQ ID NO: 472 - DNA, 302 bp, Zea mays
  unsure (1)..(302): unsure at all n locations
gtcttggctgaccccagcngaaggggactgcgtgcgctctcgcgtgcccagatcgactctgttcttgaccttgctcggtgcaccattgtgtccgagctctcaaacgaggacttcgactcttatgtcttatctgagtcgagcctgtttgtctacccatacaagattgtgatcaagacctgtggaactacaaagcttctgctcgctattccgaggatccttgaacttgctgaagagctcctgttgccactcgctgcagttanatactcccgtggaacgttcatattccctgaagcacagccttc

SEQ ID NO: 473 - DNA, 489 bp, Zea mays
  unsure (1)..(489): unsure at all n locations
gggnnnnnaanttatccgncaggcaccggtcaagaattcccgggncgacccacgcgtccgcggacgcgtggggatctgtgacttcgacttcgagccctgtggctactccatgaatgctttcatggccctgctttgtcgaccattcatgtgaccccagaggacggcttcagctatgcagctacgaggtcatgggcttcaacccgggctctttctcttatggtgacctggttaagaggtgctgaggtgctttggtccaactgagttctctgtcaccgtgaccatcttcggtgatcggacaatgcgaagacctgggggacgaaactggatgctgaggcctatgcttgcagcaacatgttgagcaggtgctgccgtttggtggcttgctcatctatcaaaagcttcactgttaacggcgaaacgaaccaagggtccccgangtcaagtcctgcatgaacttccccnggtgacaatttcaanaatccncncaaa

SEQ ID NO: 474 - DNA, 446 bp, Zea mays
  unsure (1)..(446): unsure at all n locations
aaagatatcaaagaccacttcccgtcttcctcccgtggctgtctgtcatctggctctgaaacgatggcagtcctgcaagttgctgctgctgcccctccccctgtctctgtgattgggttcgagggatttgagaagcgccttgagatcagcttctctgaggcacctgtcttggctgaccccagcggaaggggactgcgtgcgctctcgcgtgcccagatcgactctgttcttgaccttgctcggtgcaccattgtgtccgagctctcaaacgaggacttcgactcttatgtcttatctgagtcgagcctgtttgtctacccatacaagattgtgatcaagacctgtggaactacaaagcttctgctcgctattccgaggatcttgaacttgctgaaaaactcctggtgccactcgctgcaagttaaatactnccgtggaacgttcat

SEQ ID NO: 475 - DNA, 294 bp, Zea mays
  unsure (1)..(294): unsure at all n locations
tcggtgcaccattgtgtccgagctctcaaacgaggacttcgactcttatgtcttatctgagtcgagcctgtttgtctacccatacaagattgtgatcaagacctgtggaacnacaaagcttctgctcgctattccgaggatccttgaacttgctgaagagctcctgttgccactcgctgcagttaaatactcccgtggaacgttcatattccctgaagcacagccttccccacacaagaacttcgctgacgaggttgccttcctgaatcgcttcttcggtggcctcaagtccgg

SEQ ID NO: 476 - DNA, 314 bp, Zea mays
  unsure (1)..(314): unsure at all n locations
ctctagagatgtgcatgactgggctggacaagaagaaagcttctgtcttcttcaagaccantgcngatggttannnngnngtgcgcnaaggngatgaccaagctctctggtatctcggacatcatcccagagatggagatctgtgacttcgacttcgagccctgtggctactccatgaatgctgttcatggccctgctttgtcgaccattcatgtgaccccagaggacggcttcagctatgcaagctacgaggtcatgggctttaacccgggctctttctcttatggtgactggttaagagggtgctgaggtgt

SEQ ID NO: 477 - DNA, 309 bp, Zea mays
  unsure (1)..(309): unsure at all n locations
cgcatgcacgcgtacgtaagctcggaattcggctcgagggtcagccaagacaggtgcccagatcgactctgttcttgaccttgctcggtgcaccattgtgtccgagctctcaaatgacgactttgactcttatgtcttatctgagtcgagcctgtttgtctacccgtacaagattgtgatcaagacctgtggaactacaaagcttctgctcgctattccgagnatccttgaacttgctgaagagctcctgttgccactcgctgcagttaaatactcccgtggaacgttcatattccctgaagcacaacc

SEQ ID NO: 478 - DNA, 245 bp, Zea mays
  unsure (1)..(245): unsure at all n locations
ctgggctggacaagaagaaagcttctgtcttcntcaagaccactgctgatggttactcgctgtgcgccaaggagatgaccaagctctctggtatctcggacatcatcccagagatggagatctgtgacttcgacttcgagccctgtggctactccatgaatgctgttcatggccctgctttgtcgaccattcatgtgaccccagaggacggcttcagctatgcaagctacgaggtcatgggcttt

SEQ ID NO: 479 - DNA, 592 bp, Zea mays
  unsure (1)..(592): unsure at all n locations
tnnaatnatttngnntgagtgtatatgnngtgtngaganattnaaacccncnngaattcccgggtcgacccacgcgtccggtcaggcgncaatgctnatgtgattggggantctgcnaagcccggtcagaagtggcacgtgtactaggccgctnagcaccntgaggagcctgtcgttactctggagatgtgcatgactgggctggacaagaagaaagcttctgtattgttcaagaccactgctgatggttactngctgtgcgccaaggagatgaccaagctctctggtatntnggacatcattccagagatggagatctgtgacttcnacttngagccctgtgggctactnnatgaatgctgttcatggccctgnttttgtcgaccattcatgtgaccccaaaaggacggnttttaactnntgcaagctacgaggttatgggctttaaacccnggncttttttnnnatgggggacctnngtaaaaaggggtgctgaagttncttttggtccaactgaattnntntgttgnctgagacnatttnnngtgatcgggacnanttcgantaacttnggggncnaaaacttagtgnt

SEQ ID NO: 480 - DNA, 260 bp, Zea mays
ccactcgctgcagttaaatactcccgtggaacgttcatattccctgaagcacagccttccccacacaagaacttcgctgacgaggttgccttcctgaatcgcttcttcggtggcctcaagtccggtggcaatgcttatgtgattggtgactctgcgaacccgggcagaagtggcacgtctactacgccgctgagcaccctgaggagcctgttgttactctagagatgtgcatgactgggctggacaagaagaaagcttct

SEQ ID NO: 481 - DNA, 249 bp, Zea mays
  unsure (1)..(249): unsure at all n locations
ttccctgaagcacagccttccccacacaagaacttcgctgacgaggttgcnttcctgaatcgcttcttcggtggcctcaagtccggtggcaatgcttatgtgattggtgactctgcgaacccgggcagaagtggcacgtctactacgccgctgagcaccctgaggagcctgttgttactctagagatgtgcatgactgggctggacaagaagaaagcttctgtcttcttcaagaccactgctgatggtt

SEQ ID NO: 482 - DNA, 258 bp, Zea mays
gagatctgtgacttcgacttcgagccctgtggctactccatgaatgctgttcatggccctgctttgtcgaccattcatgtgaccccagaggacggcttcagctatgcaagctacgaggtcatgggctttaacccgggctctttctcttatggtgacctggttaagagggtgctgaggtgctttggtccaactgagttctctgttgccgtgaccatcttcggtgatcgggacaatgcgaagacctgggggacgaaactg

SEQ ID NO: 483 - DNA, 198 bp, Zea mays
gctgtgcgccaaggagatgaccaagctctctggtatctcggacatcatcccagagatggagatctgtgacttcgacttcgagccctgtggctactccatgaatgctgttcatggccctgctttgtcgaccattcatgtgaccccagaggacggcttcagctatgcaagctacgaggtcatgggcttcaacccgggctc

SEQ ID NO: 484 - DNA, 246 bp, Zea mays
  unsure (1)..(246): unsure at all n locations
ttcatgtgaccccagaggacggcttcagctatgcaagctacgaggtcatgggctttancccgggctctttctcttatggtgacctggttaagagggtgctgaggtgctttggtccaactgagttctctgttgccgtgaccatcttcggtgatcgggacaatgcgaagacctgggggacgaaactggatgctgaggcctatgcttgcagcaacatggttgagcaggtgctgccgtttggnggcttgc

SEQ ID NO: 485 - DNA, 302 bp, Zea mays
  unsure (1)..(302): unsure at all n locations
ctacccatacaagattgtgatcaagaccngtggaacnacaaagcttctgctcgctatnccgaggatccttgaacttgctgaagagctcctgtngccacnacgctgcagtnaaatacnccccgtggaacgttcatattccctgaagcacagccttccccacacaagaacttcgctgacgaggttgccttcctgaatcgcttcttcggnggcctcaagtccggnggcaatgcttatgtgattggngacnctgcgaacccgggcagaagtngcagtctanacgccgctgagcacnctgaggagcc

SEQ ID NO: 486 - DNA, 524 bp, Zea mays
  unsure (1)..(524): unsure at all n locations
gnggggggngcaattctnctnttcgtgccgtccattaatcaagggnccncccacgcgtccgaanccctgaaagcacagccttccccacacaagaacttcgctgacgaggttgccttcctgaatccgcttcttcggtggcctcaagtccggtggcantgcttatgtgattggtgactctgcgaagcccgggcagaagtggcacgtctactacgccgctgaagcaccctgaggagcctgttgttactctaagagatgtgcatgactgggctggacaagaagaaagcttctgtcttcttcaagaccaactgctgatggttactcgctggtgcgccaaggagatgaccaaagctctctggtatctcgggacatcatcccaagagatggagatctgtgactcgacttcgaagccctgtggctactccatgaatgctgttcaatggccctgcttttgtcgaancattcatgtgancccaagagggacggctttcagctattccaagcttacnaaggtcatgggctttaac

SEQ ID NO: 487 - DNA, 178 bp, Zea mays
  unsure (1)..(178): unsure at all n locations
aagctctctggtatctcggacatcatcccagagatggagatctgtgacttcgacttcnagccctgtggctactccatgaatgctgttcatggccctgatttgtcgaccattcatgtgaccccagagganggcttcagctatgcaagcnacgaggtcatgggctttaacnngggctctt

SEQ ID NO: 488 - DNA, 238 bp, Zea mays
  unsure (1)..(238): unsure at all n locations
cttcagctatgcaagctacgaggtcatgggctttaacccgggctctttctcttatggtgacctggttaagagggtgctgaggtgctttggtccaactgagttctctgttgccgtgaccatcttcggtgatcgggacaatgcgaagacctgggggacgaaactggatgctgaggcctatgcttgcagcaaaatggttaaacagttctgccgttgggggnttcccacannaaaanaactt

SEQ ID NO: 489 - DNA, 304 bp, Zea mays
agaaaccacctgcattttcattttgatctccctaatccctccggctagctgctttccagtgaccaaaagatatcaaagaccacttcccgtcttcctcccgtggctgtctgtcatctggctctgaaacgatggcagtcctgcaagttgctgctgctgcccctccccctgtctctgtgattgggttcgagggatttgagaagcgccttgagatcagcttctctgaggcacctgtcttggctgaccccagcggaaggggactgcgtgcgctctcgcgtgcccagatcgactctgttcttgaccttgc

SEQ ID NO: 490 - DNA, 229 bp, Zea mays
  unsure (1)..(229): unsure at all n locations
gaagacgggaagtggtctttgatatcttttggtcactggaacgatggcagtcctgcaagttgctgctgctgcccctccccctgtctctgtgattgggttcgagggatttgagaagcgccttgagatcagcttctctgaggcacctgtcttggctgaccccagcggaaggggactgcgtgcgctctcgcgtgcccagatcgactctgttcttnacttgctcggtgcacca

SEQ ID NO: 491 - DNA, 290 bp, Zea mays
  unsure (1)..(290): unsure at all n locations
gctgaggtgctttggtccaactgagttctctgttgccgtgaccatcttcggtgatcgggacaatgcgaagacctgggggacganaactggatgctgaggcctatgcttgcagcaacatggttgagcaggtgctgccgtttggtggcttgctcatctatcagagcttcactgttacggccgaaacgacccatgggtcgccgaggtcagtcctgcatgacttcgctggtgacattgtcaagaatcgctcagagagtgatgctccctgggaagctgatgctgtggatgcggng

SEQ ID NO: 492 - DNA, 289 bp, Zea mays
  unsure (1)..(289): unsure at all n locations
tgactcttatgtcttatctgagtcgagcctgtttgtctacccgtacaagattgtgatcaagacctgtggaactacaaagctatctgctcgctattccgaggatccttgaacttggctgaagagctcctgttgccactcgctgcagttaaatactcccgtggaacgttcatattccctgaagcacaaccttccccaacacaagaacttcgctgacgagggttgccntnctgaatcgcntctcggtgggctcaangtcggtgggaaagctantgtgattgtnanncngcga

SEQ ID NO: 493 - DNA, 318 bp, Zea mays
  unsure (1)..(318): unsure at all n locations
gctgaggtgctttggtccaactgagttctctgttgccgtgaccatcttcggtgatcgggacaatgcgaagacctgggggacgaaactggatgctgaggnctatgcttgcagcaanctggttgagcaggtgctgccgtttggtggcttgctcatctatcagagcttcactgttacggccgaaacgacccatgggtcgccgaggtcagtcctgcatgacttcgctggtgacattgtcaagaatcgctcagagagtgatgctccctgggaagctgatgctgtggatgagagcgaggaaagagatgtaaagaagatgnaatg

SEQ ID NO: 494 - DNA, 310 bp, Zea mays
  unsure (1)..(310): unsure at all n locations
gtcgtcatccccatcctagtagcgtagaaaccacctgcattttcattttgatctcnctaatacctccgggtagctgctttccagtgaccaaaagatatcaaagaccacttcccgtcttcctcccgtggctgtctgtcatctggctctgaaacgatggcagtcctgcaaattgctgctgctgcccctccccctgtctctgtgattgggttcgagggatttgagaagcgccttgagatcagcttctctgaggcactgtcttgggctgaccccagcggaagggactgcgtgcgctctcgcgtgcccagatcga

SEQ ID NO: 495 - DNA, 137 bp, Zea mays
atgggcttcaacccgggctctttctcttatggtgacctggttaagagggtgctgaggtgctttggtccaactgagttctctgtcaccgtgaccatcttcggtgatcgggacaatgcgaagacctgggggacgaaact

SEQ ID NO: 496 - DNA, 111 bp, Zea mays
  unsure (1)..(111): unsure at all n locations
gctgaggtnctttggtccaactgagttctctgttgccgtgcaccatcttcggtnatcgggacaatgcgaagacctgggggacnnaactggatgctgaggcctatncttagc

SEQ ID NO: 497 - DNA, 302 bp, Zea mays
gtgggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcgaactgcgcgaggaagccatcctgatatctctgtcgtcatccccatcctag

SEQ ID NO: 498 - DNA, 501 bp, Zea mays
  unsure (1)..(501): unsure at all n locations
ttnacgctttccacgtgcccaggcangaattaacgggtcganccacgcgtcngatttcnctagcaccgaagagaaatatatgccgccgcctcctcctcattcggtgaaaggtgggcggttagggttgggaagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaagttctccgctgcttactcnaactgcncgaggaagccatcctgatatctctgtcgtcatccccatcctaatagccgtnaaaaccanctggaatttcaatttgatctncccaaaatccctcgggtnnccggctttccagtgaccanagngatatcaaag

SEQ ID NO: 499 - DNA, 284 bp, Zea mays
  unsure (1)..(284): unsure at all n locations
ctcgaactgcgcgaggaagccatcctgatatctctgtcgtcatccccatcctagtagcgtagaaaccncctgcattttcattttgatctccctaatctctccggctagctgctttccagtgaccaaaagatatcagagaccacctcccgtggctgtctgccatctggctctgaaacgatggcagtcctacaagctgctgcccctccccctgtctctgtgattggattcgagggatttgagaagcgccttgagatcagcttctctgaggcacctgtcttggctga

SEQ ID NO: 500 - DNA, 166 bp, Zea mays
  unsure (1)..(166): unsure at all n locations
caagaagaagtctagcagtagtcgttcctccctgatgtacgaagctccccttggctacagcatcgaggatatccgccctgcaggcggcatcaagaagttctccgctgcttacncgaacngcgcgaggaagccatcctgatatctctgtcgtcatccccatcctagt

SEQ ID NO: 501 - DNA, 440 bp, Zea mays
gagatctcttgcctcacgacacgagcagcagaatttgtcgagggccggtggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgcctgcaggcggcatcaagaagttctccgctgcttactcgaactgcgcgaggaagccatcctgatatctctgttgtcatccccatcctaatagccgtagaaaccacctgcattttcattttgatctcctaatcccttcggctagctgcttttcaagtgaccaaaagatatcaaaagaccactttcccgtctttcttcccgtggcctgtctgcatcttggctctgaaacgatggcagtcctgcaaggt

SEQ ID NO: 502 - DNA, 300 bp, Zea mays
gaagaagtctagcagtagtcgttcctccctgatgtacgaagctccccttggctacagcatcgaggatatccgccctgcaggcggcatcaagaagttctccgctgcttactcgaactgcgcgaggaagccatcctgatatctctgtcgtcatccccatcctagtagcgtagaaacctcctgcattttcattttgatctccctaatctctccggctagctgctttccagtgaccaaaagatatcagagaccacctcccgtggctgtctgccatctggctctgaaacgatggcagtcctacaa

SEQ ID NO: 503 - DNA, 283 bp, Zea mays
ccccatcctagtagcgtagaaacctcctgcattttcattttgatctccctaatctctccggctagctgctttccagtgaccaaaagatatcagagaccacctcccgtggctgtctgccatctggctctgaaacgatggcagtcctacaagctgctgcccctccccctgtctctgtgattggattcgagggatttgagaagcgccttgagatcagcttctctgaggcacctgtcttggctgaccccagcggaaggggactgcgtgcgctctcgcgtgcccagat

SEQ ID NO: 504 - DNA, 300 bp, Zea mays
  unsure (1)..(300): unsure at all n locations
cgatctcttcggtgctagagaaatataggccgccgcctcctcctcattcggtgaaaggtgggcggttagggttgggagatctcttgactcacgacacgagcagcagaattcgtcgagggccgctggttgctgcgagangtccgggccttcgtgggatcttgaaaattgaatgttctaatggagtccaagggtggcaagaagaagtctagcagtagtcgttcctccctgatgtacgaagctccccttggctacagcatcgaggatatccgccctgcangcggcatcaagaagttctccgct

SEQ ID NO: 505 - DNA, 313 bp, Zea mays
  unsure (1)..(313): unsure at all n locations
atcgattccccccgcatctgatctcttcggtgctagagaaatataggccgccgccgcctcctccttgttcggtgaaaggtgggcagttagggttgggagatctcttgactcacgacacgagcagcagaattcgtcgagggccgctggttgctgcgagangtccgggccttcgtgggatcttgaaaattgaatgttctaatggagtccaagggtggcaagaagaagtctagcagtagtcgttcctccctgatgtacgaagctccccttggctacagcatcgaggatatccgccctgcaggcggcatcaagaatt

SEQ ID NO: 506 - DNA, 283 bp, Zea mays
  unsure (1)..(283): unsure at all n locations
agatntcntcggtgctagagaaatataggccgccgcctcctcctcattcggtgaaaggtgggcggttagggntgggagatctcntgactcacgacacgagcagcagaattcgtcgagggccgctggttgctgcgagangtccgggccttcgtgggatcttgaaaattgaatgttctaatggagtccaagggtggcaagaagaagtctagcagtagtcgttcctccctgatgtacgaagctccccttggctacagcatcgaggatatccgccctgcaggcggca

SEQ ID NO: 507 - DNA, 304 bp, Zea mays
  unsure (1)..(304): unsure at all n locations
gaaatcgattcccccgcatccgatctcttcggtgctagagaaatataggccgccgcctcctcctcattcggtgaaaggngggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgccctgcaggcggcat

SEQ ID NO: 508 - DNA, 439 bp, Zea mays
  unsure (1)..(439): unsure at all n locations
gaaatcgattcccccagcatctgatctcttcggtgctagagaaatataggccgccgccgcctcctcctcattcggtgaaaggtgcgcagttagggttgggagatctcttgcctcacgacacgagcagcagaatttgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgcctgcaggcggcatcaagaagttctccgctgcttactcgaactgcgcgaggaaaccatnctgatatctctggtgncattcccattctaatagccgtagaaaccacctgnattttcaatttgaacttcccttttaaaaatccttccg

SEQ ID NO: 509 - DNA, 453 bp, Zea mays
  unsure (1)..(453): unsure at all n locations
cgcgtggttcgttaggaaaggaaatgggattcccccagcatctgatctcttcggtgctagagaaatatangccggcgncgcctnctactcattcggtgaaaggtgcgcagttagggttgggagatctcttgcctcacgacacgagcagcagaatttgtcgagggccgntggttgctgcgagaggtccnggccttcgtgggatcttgaaaattgaatgttctaatggagtccaagggttgcaangaaagaaatctagcagtagtcgttccttcctgatgtacgaaacttccnttggctncaacatcgaggatattcgcccttgaagcngcattaaananttnttcnntngttactnnaantttnccangaaaccattcttaaatnctttgtngnattcccatcctaatacgtttnaaacanctgaatttcaattgacttctnaaaanctagggt

SEQ ID NO: 510 - DNA, 261 bp, Zea mays
  unsure (1)..(261): unsure at all n locations
ccgatctcttcggtgctagagaaatataggccgccgcctcctcctcattcggtnaaaggtgggcggttagggttgggagatctcttgactcacgacacgagcagcagaattcgtcgagggccgctggttgctgcgagangtccgggccttcgtgggatcttgaaaattgaatgttctaatggagtccnagggtggcaagaagaagtctagcagtagtcgttcctcctgatgtacgaagctccccttggntacagcatcgag

SEQ ID NO: 511 - DNA, 190 bp, Zea mays
  unsure (1)..(190): unsure at all n locations
ccgccctgcaggcggcatcaagaagttctccgctgcttactcgaactgcgcgaggnagccatcctgatatctctgtcgtcatccccatcctagtagcgtagaaacctcctgcattttcattttgatcnccctaatctctccggctagctgctttccagtgaccaaaagatatcagagaccacctcccgtg

SEQ ID NO: 512 - DNA, 307 bp, Zea mays
cgcgtggttcgttaggaaaggaaatcgattccccccgcatctgatctcttcggtgctagagaaatataggccgccgccgcctcctccttgttcggtgaaaggtgggcagttagggttgggagatctcttgactcacgacacgagcagcagaattcgtcgagggccgctggttgctgcgagaggtccgggccttcgtgggatcttgaaaatgaatgttctaatggagtccaagggtggcaagaagaagtctagcagtagtcgttcctccctgatgtacgaagctccccttggctacagcatcgaggat

SEQ ID NO: 513 - DNA, 307 bp, Zea mays
gaaatcgattccccccgcatctgatctcttcggtgctagagaaatataggccgccgccgcctcctccttgttcggtgaaaggtgggcagttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgccctgcagcggcat

SEQ ID NO: 514 - DNA, 274 bp, Zea mays
  unsure (1)..(274): unsure at all n locations
agaaatcgattcccccgcatccgatctcttcggtgctaganaaatataggccgccgcctcctcctgcattncggtgaaaggtgggcggttagggttgggagatctcttgactcacgacacgagcagcagaattcgtcgagggccgntggttgctgcgagaggtccgggccttcgtgggatcttgaaaattgaatgttctaatggagtccaagggtggcaagaagaagtctagcagtagtcgttcctccctgatgtacgaagtcccctggctaca

SEQ ID NO: 515 - DNA, 290 bp, Zea mays
aaatcgattcccccgcatccgatctcttcggtgctagagaaatataggccgccgcctcctcctcattcggtgaaaggtgggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgcc

SEQ ID NO: 516 - DNA, 291 bp, Zea mays
  unsure (1)..(291): unsure at all n locations
gtcgcangcacgcgtacgtaagctcggaattcggctcgagntcgattcccccgcatccgatctcttcggtgctagagaaatataggccgccgcctcctcctacattacggtgaaaggtgggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgt

SEQ ID NO: 517 - DNA, 305 bp, Zea mays
gtggttcgttaggaaaggaaatcgattccccccgcatctgatctcttcggtgctagagaaatataggccgccgccgcctcctccttgttcggtgaaaggtgggcagttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggat

SEQ ID NO: 518 - DNA, 297 bp, Zea mays
atcgattcccccgcatccgatctcttcggtgctagagaaatataggccgccgcctcctcctcattcggtgaaaggtgggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgccctgcaggcg

SEQ ID NO: 519 - DNA, 301 bp, Zea mays
gtggttcgttaggaaaggaaatcgattcccccgcatccgatctcttcggtgctagagaaatataggccgccgcctcctcctcattcggtgaaaggtgggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggat

SEQ ID NO: 520 - DNA, 287 bp, Zea mays
  unsure (1)..(287): unsure at all n locations
aaggnaatcgatncccccgcatccgatcncttcggtgctagagaaatataggccgccgcctccncctcattcggtgaaaggngggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggat

SEQ ID NO: 521 - DNA, 298 bp, Zea mays
  unsure (1)..(298): unsure at all n locations
gaaatcgattcccccgcatccgatctcttcggtgctagagaaatataggccgccgcctcctcctcattcggtgaaaggtgggcggttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccgccctgcang

SEQ ID NO: 522 - DNA, 313 bp, Zea mays
  unsure (1)..(313): unsure at all n locations
cgcgtggttcgttaggaaaggaaatcgattccccncgcatctgatctcttcggtgctagagaaatataggccgccgccgcctcctccttgttcggtgaaaggtgggcagttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttcctccctgatgtacgaagctccccttggctacagcatcgaggatatccg

SEQ ID NO: 523 - DNA, 265 bp, Zea mays
  unsure (1)..(265): unsure at all n locations
cgcgtggttcgttaggaaaggaaatcgattccccccgcatctgatctcttcggtgctagagaaatatangccgccgccgcctcctccttgttcggtgaaaggtgggcagttagggttgggagatctcttgactcacgacacgagcagcagaattcgtcgagggccgctggttgctgcgagaggtccgggccttcgtgggatcttgaaaattgaatgttctaatggagtccaagggtggcaagaagaagtctagcagtagtcgttc

SEQ ID NO: 524 - DNA, 272 bp, Zea mays
  unsure (1)..(272): unsure at all n locations
gngtggttcgttaggaaaggaaatcgatncnncccgcatctgatcncntcggtgctagagaaatataggccgccgccgcnncccncccttgttcggtgaaaggngggcagttagggttgggagatcncttgactcacgacacgagcagcagaattcntcgagggccgctggttgcngcgagaggnccgggccttcgtgggatcttgaaaattgaatgtnctaatggagtncaagggtggcaagaagaagtctagcagtagtcgttcctccct

SEQ ID NO: 525 - DNA, 550 bp, Zea mays
  unsure (1)..(550): unsure at all n locations
agttataagngggggntagnaaggaacgctntnccggtccggaattcccgggtcgacccacgcgtccgcagcattgaggacgttcgacctgccggaggcgtgaagaagttccagtctgctgcttactccaactgcgcgaagaagccatcctgatatcccttttggcttcctcattctagtagnttaggatttcttttctgacactttgattctgaccaatctctctggcctgctgcttcctgataatcgaccagttccccagtcttgctccttgcactcctccctccatctccagcattgtgttctgattcacctgctccaatggctgttctttctgctgctgatgcttcccggtctcagctatcgggtttgagggctatgagaagcgccttgagatcacattctctgaggcacctgtctttgtggaccctcatgggccgtggtttgcgtgccctctncagggcccanattgactctgttctggatcttgcacggtgcacaattgtgtncganctctncaacaaggatttcgactcatatgtcctttctg

SEQ ID NO: 526 - DNA, 537 bp, Zea mays
  unsure (1)..(537): unsure at all n locations
taatgtgntnnnnttggggntnggggaggananngtaantgcttctaccggtccggaattcccgggtcgacccacgcgtccgcaaagctctctggcatctctgaaatcatccccgagatggagatctgcgattttgactttgaaccctgtggctactccatgaatgcgatccatggctctgcattctccacaatccatgtgacgcccgaggacggtttcagctatgccagttatgaggttatgggcttggatgccactgctctgtcttatggtgaccttgtcaagagggtccttcggtgctttggcccctcggagttttccgttgccgtgaccatcttcggcgggcgtggccatgccgggacatggggaaaggcacttggtgcagaggtctatgactgcaacaacatggtggagcaggagctgcctggaggcggctcctcgtgtaccagagcttctgtgctgctgaagacgctgttgctacctcgcccaaatctgttttccactgctttgacggcgagaacgtggagagtgctcctc

SEQ ID NO: 527 - DNA, 544 bp, Zea mays
  unsure (1)..(544): unsure at all n locations
atgttntttantttttgggatantggtngnncttctccggtccggaattcccgggtcgacnnacgcgtccgcccacgcgtccggaagaaagcttctgtctttttcaagactaatgctgatgggaacacaacatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagctatgccagttatgaggttatgggcttggatgccactgctctgtcttatggtgaccttgtcaagagggtccttcggtgctttggcccctcggagttttccgttgccgtgaccatcttcggcgggcgtggccatgccgggacatggggaaaggcacttggtgcanaggtctatgactgcaacaacatggtggaacangagctgcctggaagcgggctnctcgtgtaccaaagcttctgtgctgctnaaacnctgntgc

SEQ ID NO: 528 - DNA, 539 bp, Zea mays
  unsure (1)..(539): unsure at all n locations
gcnggnttgnnttnggntgggggnggntaatgttaacctntccggaattcccgggtcgacccacgcgtccgcggacgcgtgggcggacgcgtggggactcatatgtcctttctgagtcaagcttgtttatctgtcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgaaatgtgcatgactggtctggacaagaaagaaagcttctgnctttttcaagactaatgctgatgggnacacaacatgtgccaaggaaatgac

SEQ ID NO: 529 - DNA, 472 bp, Zea mays
  unsure (1)..(472): unsure at all n locations
antgttacgtgngccggnngcnggcngaanttcangggtcgacgcacgcgtccgcaagccctgctcaccattccaagaatccttgagcttgctgaagagctgtctatgccacttgctgtgtgaagtactcccgtgggacgttcatctttcctggcgcacaagccagccccccacagggcttctctgaggaagttgctgcacttaaccgctactttggcggcctgaaatctggtggtatgcttatgtgattggagatccagcaagacctggacagaagtggcacgtcttctacgccctgagtacccagagcaaccaatggttaaccttgagatgtgcatgactggtctggacaagagaaagcttgtgtctttttcaagactaatgctgatgggaacacaacatgtgccaaggaatgacaaagctctctggcatctctgaaatcatccccgagatggagatctgcgattttgac

SEQ ID NO: 530 - DNA, 421 bp, Zea mays
cgaggacggtttcagctatgccagttatgaggttatgggcttggatgccactgctctgtcttatggtgaccttgtcaagagggtccttcggtgctttggcccctcggagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaaactggctaatcttctatgctgggaggaggaagcggatgccatggaggagaaggcgggagtgcttgat

SEQ ID NO: 531 - DNA, 437 bp, Zea mays
cacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctcctctcatctcagcattgtgttctgattcacctgctccaatggctggtctttctgctgctgatgcttccccggtctcagctatcgggtttgagggctatgaaaaagcgccttgagatcacat

SEQ ID NO: 532 - DNA, 472 bp, Zea mays
  unsure (1)..(472): unsure at all n locations
cttcttttgcccgccaggtacaagtaaggaattcccggntcgacccacgcgtcngcaagatccttgagcttgctgaagagctgtctatgccacttgctgctgtgaagtactcccgtggacgttcatctttcctggcgcacagccagccccccacaggagcttctctgaggaagttgcgcacttaaccgctactttggcggcctgaaatctggtggtaatgcttatgtgattggagaccagcaagacctggacagaagtggcacgtcttctacgccactgagtacccagagcaaccatggttaaccttgaaatgtgcatgactggtctggacaagaagaaagcttccgtcnttttaaagactaatgctgatgggaacacaacatgtgccaaggaaatgacaaagctctctggcactctgaaatcatccccgagatggagatctgcgattttgactttgaaccctgtggctacc

SEQ ID NO: 533 - DNA, 432 bp, Zea mays
  unsure (1)..(432): unsure at all n locations
cctcgcccaaatctgttttccactgctttgacggcgagaacgnggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgaacgtatggagaaatatctgtgaacccattttgnttatgaataagatttgntttttt

SEQ ID NO: 534 - DNA, 501 bp, Zea mays
  unsure (1)..(501): unsure at all n locations
cgnggctngtnngngtgggatttnnatgaancgtctctaccggtcnggaattcccgggtcgacccacgcgtccggagcaaccaatggttaaccttgaaatgtgcatgactggtctggacaagaagaaagcttctggctttttcaagactaatgctgatgggaacacaacatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagctatgccagttatgaggttatgggcttggatgccactgctctgtcttatggtgaccttgtcaagagggtccttcggtgctttggcccctcggagttttccgttgcccgtgaccatcttcngcggccgtggccatgccnggacatggggaaaggcacttggtgcanaggtctatgac

SEQ ID NO: 535 - DNA, 477 bp, Zea mays
  unsure (1)..(477): unsure at all n locations
ttnnaacncnacgcggnncngaaccggtcngcngaattcccgggccgacccacgcgtcncggacgcgtgggctgaaatctggtggtaatgcttatgtgattggagatccagcaagaccggacagaagtggcacgtcttctacgccactgagtacccagagcaaccaatggttaacctgagatgtgcatgactggtctggacaagaagaaagcttgtgtctttttcaagactaatgcgatgggaacacaacatgtgccaaggaaatgacaaagctctctggcatctctgaaatcatcccgatatggagatctgcgattttgacttcgaaccctgtggctactccatgaatgcgatcatggctctgcattctccacaatccatgtgacgcccgaggacggtttcaagctacgccattacgangttatgggcttggatgccactgctctgtcttatggtgaccttgtcaaganggcctcc

SEQ ID NO: 536 - DNA, 442 bp, Zea mays
  unsure (1)..(442): unsure at all n locations
gcatgactggtctggacaagaagaaagcttgtgtctttttcaagactaatgctgatgggaacacancatgtgccaaggaaatgacaaagctctctggcatctctgaaatcatccccgagatggagatctgcgattttgacttcgaaccctgtggctactccatgaatgcgatccatggctctgcattctccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcanaagtctatgactgcacancatggtggaacangaacttgcctggagcggcttctct

SEQ ID NO: 537 - DNA, 421 bp, Zea mays
  unsure (1)..(421): unsure at all n locations
ctgaatagntgtctatgccacttgctgctgtgaaggnctncnntgggacgttcatctttnctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgaaatgtgcatgactggtctggacaagaagaaagcttctgtctttttcaagactaatgctgatgggaacacaacatgtgccaaggaaatgacaaagctctctggcatctctgaaatcatccccgagatggagatctgcgattttgactttgaaccctgtggctacttcatgaatgccaancc

SEQ ID NO: 538 - DNA, 410 bp, Zea mays
  unsure (1)..(410): unsure at all n locations
gtctttttcaagactaatgctgatgggaacacaacatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagctatgccagttatgaggttatgggcttggatgccactgctctgtcttatggtgaccttgtcaagagggtccttcggtgctttggcccctcggagttttccgttgccgtgaccatcttcggcgggcgtggccatgccgggacatggggaaaggcacttggtgcagaggtctatgactgcaacaacatggtggagcangagctgcctggaggcgggcttct

SEQ ID NO: 539 - DNA, 475 bp, Zea mays
  unsure (1)..(475): unsure at all n locations
gnggnnnnnngnttnttagcngccngcaccaatcaaagantcgcgggtcganncacgcgccnctccctcnatctccagcattgtgttctgattcacctgctccaatggctgttctttcgctgctgatgcttccccggtctcagctatcgggtttgagggctatgagaagcgccttgaatcacattctctgaggcacctgtctttgtggaccctcatgggcgtggtttgcgtgcccttccagggcccagattgactctgttctggatcttgcacggtgcacaattgtgtctgagcttccaacaaggatttcgactcatatgtcctttctgagtcaagcttgtttatctatcctctaagattgtcatcaagacctgtggcactaccaagctcctgctcaccattccaagaatcctgagcttgctgaagaactgtctatgccacttgctgcgtgaaataatcccgttgggaacgtcat

SEQ ID NO: 540 - DNA, 500 bp, Zea mays
  unsure (1)..(500): unsure at all n locations
ggnnnnnnnnnngttaacttcnacgccggtcggtacanagtccnggaattcccgggtcgcccacgcgtccgcccacgcgtccgcaaagctctctggcatctctgaaatcatccccgagtggagatctgcgattttgacttcgaaccctgtggctactccatgaatgcgatccatggcctgcattctccacaatccatgtgacgcccgaggacggtttcagctacgccagttacgagttatgggcttggatgccactgctctgtcttatggtgaccttgtcaagagggtcctccgggctttggcccctcagagttttccgttgccgtgaccatcttcggcgggcgtggccatgccggacatggggaaaggcacttggtgcagaggtctatgactgcaacaacatggtggaacagagctgcctggaagcgggctcctcgtgtaacaaaactttcgtnccgctgaaaancccgttccaactccccnaaatcntttttcaanng

SEQ ID NO: 541 - DNA, 508 bp, Zea mays
  unsure (1)..(508): unsure at all n locations
agnnaggagnggtgnnncatngnntagnggntnaannaaatncncgtaccggtccggaatcccgggtcgacccacgcgtccgctccagcattgtgttctgattcacctgctccaatggctgttctttctgctgctgatgnttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctctccaacaaggatttcgactcatatgtcctctctgagtcaagcttgtttatctatcctctgaagattgtcatcaagacctgtggcactaccaagctcctgctcaccattccaagaatccttgagcttgctgaagaagctgtctatgccacttgctgctgtgaaagtacttccgtgggacgtcatctttcctggtgcacac

SEQ ID NO: 542 - DNA, 468 bp, Zea mays
  unsure (1)..(468): unsure at all n locations
ggnnnnngtactttanntnncagaggcctggtcaagnncaagcgggtcganncangcntnncncagacttctgcgntctcagctatcgggtttgagggctatgagaagcgccttgagacacattctctgaggcacctgtctttgtggaccctcatgggcgtggtttgcgtgccctctcagggcccagattgactctgttctggatcttgcacggtgcacaattgtgtctgagctctcaacaaggatttcgactcatatgtcctttctgaagtcaagcttgtttatctatcctctgagattgtcatcaagacctgtggcactaccaagctcctgctcaccattccaagaatccttagcttgctgaagagctgtctatgccacttgctgctgtgaagtactcccgtgggacgttctctttcctgggcgcacagccagccccccacangagcttctctgangaagttgctg

SEQ ID NO: 543 - DNA, 494 bp, Zea mays
  unsure (1)..(494): unsure at all n locations
ggnngnaacttctacgccgccggtttcggtcgncaaattcccgggtaaacccacgcgtcgnccacgcgtccgcccacgcgtccggggtccttcggtgctttggcccctcggagttttcgttgccgtgaccatcttcggcgggcgtggccatgccgggacatggggaaaggcacttgggcagaggtctatgactgcaacaacatggtggagcaggagctgcctggaggcgggctcctgtgtaccagagcttctgtgctgctgaagacgctgttgctacctcgcccaaatctgttttcactgctttgacggcgagaacgtggagagtgctcctcctcctatgaagaaggactacaactggctaatcttctatgctgggaggaggaagcggatgccatggaggagaangcgggagtcttgatgagtaagacgggcttctggggtccaattgcctccganttggttaatttaaaactcccaaatttntgggttgcctt

SEQ ID NO: 544 - DNA, 511 bp, Zea mays
  unsure (1)..(511): unsure at all n locations
agtgtnaannggntggnnggnnangttntnctgtacngaanngnannntcgaccnanncgtacgctttcggctacgnnattctantagtttaggatttcttttctgacactttgattctgaccaatctcnctggcctgctgcttcctgataatcgaccagttccccagtcttgctccttgcactcctccctccatctccagcattgtgttctgattcacctgctccaatggctgntctttctgctgctgatgcttcccggtctcagctatcgggtttgagggctatgagaagcgccttgagatcacattctctgaggcacctgtctttgtggaccctcatgggcgtggtttgcgtgccctntncaggggccagattgactctggtctggatcttgcacggtgcacaattgtgtncgagctnttcaacaaggatttcgactnatatgtccttctgaatcaaacctggttatctatcctctgnaaaatggcaatcaaaaacctgtgggactac

SEQ ID NO: 545 - DNA, 478 bp, Zea mays
  unsure (1)..(478): unsure at all n locations
ttnnntgccnngccggtcnangtcacaangncccgggtcgacccacgcgtccnttggggtcacctgctccaatggctgttctttctgctgctgatgcttccccggtctcaagctatcggtttgagggctatgagaagcgccttgagatcacattctctgaggcacctgtctttgtggccctcatgggcgtggtttgcgtgccctctccagggcccagattgactctgttctggatctgcacggtgcacaattgtgtctgagctctccaacaaggatttcgactcatatgtccttttgagtcaagcttgtttatctatcctctgaagattgtcatcaagacctgtggcactaccagctcctgctcaccattccaagaatccttgagcttgctgaagaactgtctaagccacttgtgctgtgaaataccccntgggaaattnaaacctttccnggngcaaancaaccccccacagagctt

SEQ ID NO: 546 - DNA, 533 bp, Zea mays
  unsure (1)..(533): unsure at all n locations
ggnnaggncaggtttganngnnggnatgggggaaatnnttcgcccggaattcccgggtcgacccacgcgtccgtgaagattgtcatcaagacctgtggcactaccaagctcctgctcacaattccaaggatcctagagcttgctgaagagctgtctatgcctcttgctgctgtgaagtactcccgcgggacgttcatctttcctggcgcacagccagccccccaccggagcttctccgaggaagttgctgtacttaaccgatactttgggggcctgaagtctggtggcaatgcttatgtgattggagatgcagcaagaccaggacagaagtggcacatctactacgccactgagtacccanagcaaccaatggtcaaccttgagatgtgcatgactggtctggacacgaagaaagcttcagtcttcttcaagactaatgctgatggcaacacaacatgttccaagggaatgaccaaactttttggnatctctgaaattattcctggaaatgganatttgngattttgactnca

SEQ ID NO: 547 - DNA, 485 bp, Zea mays
  unsure (1)..(485): unsure at all n locations
gggnnngtaantcactagnncgncncaatacanagncncgtnggncnntacaanncnctcagtgnttcntncnactgctttgacggcgagaacgtggagagtgctcctcctcctatgagaaggactacaagctggctaatcttctctgctgggaggaggaagcggatgccatggagggaaggcgggagtgcttgatgagtaagacgggcttctggggtcgatttgcttctgagttgttattttatatcgtcgcaatttcgtggttgtcgtttggttattctgtgaagcagccaagcaggctattgttatgaaaatttgtcgtctgtaagcatgtgaacttccgatgttgccacagctggatnagtctgaataagtaagtatgcaactctangtggtcanctgcgtctaacacatgaagcatgaacgtntggagaaatntccgtgnaacccatttgtttatgaaaaaanattgntttttcnaattt

SEQ ID NO: 548 - DNA, 442 bp, Zea mays
  unsure (1)..(442): unsure at all n locations
cggacncntggggtggctactccatgaatgcgatccatggctctgcattctccacaatccatgtgacgcccgaggacggtttcagctatgccagttatgaggttatgggcttggatgccactgctctgtcttatggtgaccttgtcaagagggtccttcggtgctttggcccctcggagttttccgttgccgtgaccatcttcggcgggcgtggccatgccgggacatggggaaaggcacttggtgcaaaggtctatgactgcaacaacatggtggaacaagagctgcctggaggcgggctcctcgtgtaccaaancttctgtgctgctgaagacgctgttgctacctccccaaatctgtttttcactgctttgaccgcnaaaacgtggaaaagtgcttctctctatnaaagaaagactacaaactggctaatcttntatgg

SEQ ID NO: 549 - DNA, 449 bp, Zea mays
  unsure (1)..(449): unsure at all n locations
gggaagttgctgcacttaaccgctactttggcggcctgaaatctggtggtaatgcttnngtgnntggagatccagcaagacctggacagaaatggcacgtcttctacgccactgagtacccagagcaaccaatggttaaccttgaaatgtgcatgactggtctggacaagaagaaagcttctgtctttttcaagactaatgctgatgggaacacaacatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacgggttcagctatccagttatgaaggtatnggcttggatcccctgctcttgcntatngggancctttcnagaagggtccttcggg

SEQ ID NO: 550 - DNA, 512 bp, Zea mays
  unsure (1)..(512): unsure at all n locations
ggngnnnnnntggnnngngnaattntacgccgtcngtagcctcanagaattccaaggtcacccacccgtccnatttcttntctgacactttgnttctgaccantctctctggcctgctcttcctganantcnatcatgttccncaggtcttgctccttgcactcctccctccatctcagcattgtgttctggttcaccttgctccaatggctgttctttctgntgctgatgcttcccggtctcanctatcgggtttgagggcnatgagaagcgccttgagatcanattctccgagcacctgtctttgtggaccctcatgggcgtggtttgcgtgccctctccagggcccacattantctgttctggatctgcacngtgcacnnttgtgtctgagctctccaacacggnnttcgctcaatatgtcctttctgagtcaagcttgtttatctatcctctgnagattgtnntcaatccngtggnactaccaagctcctgctcaatantcnaagaat

SEQ ID NO: 551 - DNA, 448 bp, Zea mays
  unsure (1)..(448): unsure at all n locations
ggcggcctgaaatctggtggtaatgcttatgtgattggagatccagcaagacctggacagaagtggcacggggnctacgccactgagtcccagagcaaccaatggttaaccttgaaatgtgcatgactggtctggacaaagaaganagcttctgtctttttcaaagactaatgctgatgggaacacaacatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagctatgccaagttatgaggttatgggcttggatcccactggtttggcttatggngaccttntcaaaaanggtccttcggngcttttgggcccctcggaagnttt

SEQ ID NO: 552 - DNA, 384 bp, Zea mays
  unsure (1)..(384): unsure at all n locations
atcctctgaagattgtcatcaagacctgtggcactaccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggntaaccttgagatgtgcatgactggtctggacaagaaagaaagcttctgtctttttcaaagactaaatgctgatggga

SEQ ID NO: 553 - DNA, 469 bp, Zea mays
  unsure (1)..(469): unsure at all n locations
gtgccaaggaaatgacgaagctctctggtntctctgaaattatccctgagatggggatcggtgattttgacttcgaaccctgcggctactccatgaatgcaatccatggctctgcgttctccacngatccatgtgacgcctgaggatgggttcagctacgccagttatgaggttatgggcttggatgccactgccctgtcttacggtgaccttgtcaagagggtccttgggtgcttcggcccctcagaattttctgtcgccgtgaccatcttcggcgggcggngccaagctgggacatggggaaaggaacttggtgcggaggcttatgactgcaacaacatggtcgagcaggagctgcctggaggtgggatcctcatctaccaaagcttcttgtgctgntgaaanaccccgttgctagctcgcccaaatccggtcttcgctgctttgaatggcnaanaatgcaacancc

SEQ ID NO: 554 - DNA, 347 bp, Zea mays
ctctgcattctccacaatccatgtgacgcccgaggacggtttcagctacgccagttacgaggttatgggcttggatgccactgctctgtcttatggtgacttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccatgctttgacggcgagaacgtg

SEQ ID NO: 555 - DNA, 435 bp, Zea mays
  unsure (1)..(435): unsure at all n locations
gcntnactngcctngncnngaanaaagtttttntcnntgncaanacnaatgctgatgggngggcancatgtgncaaggangtggcnaagctctatgncatntctgaaatcatccccgagatggagatctgcgattntgacttccnaccctgtggctactccatgaatgcgatccatggctctgcattctccacaatccatgtgacgcccgaggncggtttcagctacnccagttacgaggttatgggcttggatgccactgntntgtcttatggcgaccttgtcaagagggtccttcggtgctttgcccctcagagttttacgangccgtgaccatcttcngcngaagtgnccatgcctggacatgggggaaaggcacttggtgccnaggcctattnctgnnacancatggtggaacangagcngccttgangca

SEQ ID NO: 556 - DNA, 334 bp, Zea mays
caacaacatggtggagcaggagctgcctggaggcgggctcctcgtataccagagcttctgcgctgctgaagacgctgttgctacctcgcccaaatctgttttccactgctttgacggcgagaacgtggagagtgctcctcctcctatgaagaaggactacaaactagctaatcttctctgctgggaggaggaagcggatgccatggaggagaaggcgggagtgcttgatgagtaagacgggcttctggtgtcgatttgcttctgagttgtttattttatatcgtcgcaatttcgtggttgtcgtttggttattctgtgaagcagccaagccagg

SEQ ID NO: 557 - DNA, 404 bp, Zea mays
  unsure (1)..(404): unsure at all n locations
gnnaggnnnnttnnnatgggnggnnatntnatgcancgctcgtaccggtccggaattcccgggtcgacccacgcgtccgctcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtac

SEQ ID NO: 558 - DNA, 430 bp, Zea mays
  unsure (1)..(430): unsure at all n locations
atcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctctncaacaaggatttcgactcatatgtcctttctgagtcaagcttgtttatctatcctctgaagattgtcatcaagacctgtggcactaccaagctcctgctcaccattccaagaatccttgagcttgctgaagaactgtctatgccacttgctgntgtgaaagtactcccgtggggacgttcatctttcctggcgcacaagncaggnccccacaaggagcttnttttgaaggaagttgcttgnactttaaccggttaatttggggggccttgaaant

SEQ ID NO: 559 - DNA, 319 bp, Zea mays
gtgcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccctgtggctactccatgaatgcgatccatggctctgcattctccacaatccatgtgacgcccgaggacggtttcagctacgccagttacgaggttatgggcttggatgccactgctctgtcttatggtgaccttgtcaagagggtcctccggtgctttggcccctcagag

SEQ ID NO: 560 - DNA, 346 bp, Zea mays
  unsure (1)..(346): unsure at all n locations
tggagatccagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatcnttnagatggagatctgcgattttgacttcgaaccctgtggctactccatgaatgcgatccatggctctgcattctccacaatccatgtgacgcccgaggacggtttcagtacgccattacgaggttatgggcttggatgccatgct

SEQ ID NO: 561 - DNA, 317 bp, Zea mays
gtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccctgtggctactccatgaatgcgatccatggctctgcattctccacaatccatgtgacgcccgaggacggtttcagctacgccagttacgaggttatgggcttggatgccactgctctgtcttatggtgaccttg

SEQ ID NO: 562 - DNA, 342 bp, Zea mays
ccgaggaggtttcagctatgccagttacgaggttatgggcttggatgccactgctctatcttatggtgaccttgtcaagagggtcctccggtgctttggcccctcggagttttccgttgccgtgaccatcttcggcgggcgtggccatgccgggacatggggaaaggcactaggtgcagaggtctatgactgcaacaacatggtggagcaggagctgcctggaggcgggctcctcgtataccagagcttctgcgctgctgaagacgctgttgctacctcgcccaaatctgttttccactgctttgacggcgagaacgtggagagtgtcctcctcctatgaag

SEQ ID NO: 563 - DNA, 314 bp, Zea mays
gctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctccatctccagcattgtgttctgattcacctgctccaatggctgttctttctgctgctgatgcttccccggtctcagctatcgggtttgagggctatgagaagcgccttgagatcacattctctgaggcacctgtctttgtggaccc

SEQ ID NO: 564 - DNA, 541 bp, Zea mays
  unsure (1)..(541): unsure at all n locations
gtngggnnagtnttgngnctattaagccttaaacccgtacgcctgcaggtaccggtccggaattcccgggtcgacccacgcgtccggcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaaactggctaatcttctatgctgggaggaggaaccggatgccatggaggagaaggcgggagtgcttgatgagtaagacggncttntggggtngatttgcttntgagttgnttattttatatcgtngcaatttccgtggntgtcgtttggttattctgtgaagcagcnaanctatgcttattggtatnaaantttgtcgtntgtaagcntgtgnactttntactgttnccanntgcttggattaanttntnaataattnaatattntaattttnntgtnnttttttnttttntct

SEQ ID NO: 565 - DNA, 308 bp, Zea mays
caatggttaaccttgagatgtgcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccctgtggctactccatgaatgcgatccatggctctgcattctccacaatccatgtgacgcccgaggacggtttcagctacgccagttacgaggttatgggcttggatgccactgctctgtcttatggtgaccttgtcaag

SEQ ID NO: 566 - DNA, 346 bp, Zea mays
  unsure (1)..(346): unsure at all n locations
tgaagctccccttgggctacagcattgaggacgttcgacctgccggagggtggaagaagttccagtctgctgcttactccaactgcgcgaagaagccatcctgatatcccttttggcttccncattctagtagtttaggatttcttttctgacactttgattctgaccaatctctctggcctgctnttcctgataatcgaccagttccccagtcttgctccttgcactcctccctcctccatctccagcattgtgttctgattcacctgctccaatggctgttctttctgctgctgatgcttccccggtctcagctatcgggttgagggctatgagaagcgccttg

SEQ ID NO: 567 - DNA, 303 bp, Zea mays
ccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggaca

SEQ ID NO: 568 - DNA, 316 bp, Zea mays
ctactccatgaatgcgatccatggctctgcattctctacaatccatgtgacgcccgaggacggtttcagctatgccagttacgaggttatgggcttggatgccactgctctatcttatggtgaccttgtcaagagggtcctccggtgctttggcccctcggagttttccgttgccgtgaccatcttcggcgggcgtggccatgccgggacatggggaaaggcactaggtgcagaggtctatgactgcaacaacatggtggagcaggagctgcctggaggcgggctcctcgtataccagagcttctgcgctgctgaa

SEQ ID NO: 569 - DNA, 313 bp, Zea mays
acggtgcacaattgtgtccgagctctccaacaaggatttcgactcatatgtcctctctgagtcaagcttgtttatctatcctctgaagattgtcatcaagacctgtggcataccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattg

SEQ ID NO: 570 - DNA, 512 bp, Zea mays
  unsure (1)..(512): unsure at all n locations
gnnnggntgtttntnannggggnttnatggaatctcgtaccggtccggaattcccgggtcgacccacgcgtccgcggacgcgtgggcgattcttaccaatccccctggcctgctgctttcctgataatcgaccagttccccagtcttgctccctgcagtcctccctcctccatctccagcgttgtgttctgactcacctgcaccaatggctgttctttctgctgctggtgctcccccggcctcagctatcgggtttgagggctatgagaagcgccttgagatcacattctctgaggcacctgtctttgtggacccccatggcagcggtttgcgtgccctctccaggtcccagattgactctgttctggatcttgcacggtgcacgatcgtgtccgagctctccaacaaggattttgactcctatgttctctccgagtcaagcttgtcatctatcctctgaagattgncatcaagacctgtggcactaccaacttctggtacaanttccagga

SEQ ID NO: 571 - DNA, 314 bp, Zea mays
  unsure (1)..(314): unsure at all n locations
tnggagtctaagggtggcaaaaagtctagcagtagtcgttccatgatgtatgaagctccccttggctacagcattgaggacgttcgacctgccggagngtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctcctccatctccagcattgtgttctgattca

SEQ ID NO: 572 - DNA, 422 bp, Zea mays
  unsure (1)..(422): unsure at all n locations
cgccagttatgaggttatgggcttggatgccactgccctgtcttacggtgaccttgtcaagagggtccttgggtgcttcggcccctcggaattttctgtcgccgtgaccatcttcggcgggcggngccaagctgggacatggggaaaggaacttggtgcggaggcttatgactgcaacaacatggtcgagcaggagctgcctggaggtgggatcctcatctaccagagcttctgtgctgctgaagacgccgttgctagctcgcccaaatccgttcttcgctgctttgatggcgagaatgcagcaccttttgcgaaggactgcaagctggctaatcttgtctgcttggaggaagttggatgctatcgaggagaaagatggagtgcttgatgagtaaaacnggtttcttggtgncgatttgctt

SEQ ID NO: 573 - DNA, 295 bp, Zea mays
tgaatgcgatccatggctctgcattctccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagctt

SEQ ID NO: 574 - DNA, 295 bp, Zea mays
ggcgtggtttgcgtgccctctccagggcccagattgactctgttctggatcttgcacggtgcacaattgtgtctgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggag

SEQ ID NO: 575 - DNA, 299 bp, Zea mays
gtcctctctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctggacagaagtggcacgt

SEQ ID NO: 576 - DNA, 299 bp, Zea mays
ctcatatgtcctctctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctggacagaagt

SEQ ID NO: 577 - DNA, 297 bp, Zea mays
  unsure (1)..(297): unsure at all n locations
gngctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctagg

SEQ ID NO: 578 - DNA, 303 bp, Zea mays
  unsure (1)..(303): unsure at all n locations
aanttctnctacgncactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccctgtggctactccatgaatgcgatccatggctctgcattctccacaatccatgtgacgcccgaggacggtttcagctacgccagttacgaggttatgggc

SEQ ID NO: 579 - DNA, 304 bp, Zea mays
ccgaggacggtttcagctatgccagttatgaggttatgggcttggatgccactgctctgtcttatggtgaccttgtcaagagggtccttcggtgctttggcccctcggagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctt

SEQ ID NO: 580 - DNA, 340 bp, Zea mays
  unsure (1)..(340): unsure at all n locations
ttttccactgctttgacggcgngaacgtggagagtgctcctcctcctatgaagaaggactacaaactggctaatcttctatgctgggaggaggaagcggatgccatggaggagaaggcgggagtgcttgatgagtaagacgggcttctggggtcgatttgcttctgagttgtttatttatatcgtcgcaatttcgtggttgtcgtttggttatctgtgaagcagccaagccaagctattgttatgaaaattgtcgtctgtaagcatgtgaacttccgacgttgccacatgctggatcatctgaataagtaagtatgcagctctaggtgtcagctgcgtct

SEQ ID NO: 581 - DNA, 344 bp, Zea mays
  unsure (1)..(344): unsure at all n locations
tgggaacacagcatgtgccaaggaaatgacaaagctctctggcatctctgaaatcatccccgagatggagatctgcgatttgacttgaaccctgtggctactccatgaatgcgatccatggctctgcaatctccacaatccatgtgacgcccgaggacgggttcagccaagccagnaatgaggctaagggcctngaagccactgctctgtcttatggtgaccttgtcaagagggtccttcggtgctttggcccctcggagttttccgttgccgtgaccatcttcggcgggcgtggccatgccgggacatggggaaangcattggtgcagaggtctatgactgca

SEQ ID NO: 582 - DNA, 300 bp, Zea mays
atctctctggcctgctgcttcctgataatcgaccagttccccagtcttgctccttgcactcctccctcctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagct

SEQ ID NO: 583 - DNA, 298 bp, Zea mays
aaggatttcgactcatatgtcctctctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagac

SEQ ID NO: 584 - DNA, 351 bp, Zea mays
  unsure (1)..(351): unsure at all n locations
gcttgctgaagagctgtctatgccacttgctgctgtgaagtactcccgtgggacgttcatctttcctggcgcacagccagcccccccacaggagcttctctgaggaagttgctgcacttaaccgctactttggcggcctgaaatctggtggtaatgcttatgtgattggagatccagcaagatctggacagaagtggcacgtcttctacgccactgagtacccagagcaaccaatggttaaccttgagatgtgcatgactggtctggacaagaagaaagcttgtgtcttttcaagactaatgctgatngggaacacaacatgtgcccaaggnaatgacnaagctctctngc

SEQ ID NO: 585 - DNA, 291 bp, Zea mays
gtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaagctggctaatcttctctgctgggagga

SEQ ID NO: 586 - DNA, 514 bp, Zea mays
  unsure (1)..(514): unsure at all n locations
agnnnanatntgnttttttngngtgnnnngananagtacagcnntaccggtccggaattcccgggtcgacccacgcgtccgggagctgcctggaggcgggctcctcgtgtaccagagcttctgtgctgctgaagacgctgntgctacctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtngcaatttcntggttgtcgttnggttattntgnggaagnagnnaanccaggctattngtaatgaaaanntnnttnttntaatantattaactttnnnatnttntcaanattcttgatnannnttantaataanttatntaatntntaaggtntnannnttnnnttnt

SEQ ID NO: 587 - DNA, 299 bp, Zea mays
gggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccctgtggctatccatgaatgcgatccatgg

SEQ ID NO: 588 - DNA, 288 bp, Zea mays
gctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttgtcgtttggt

SEQ ID NO: 589 - DNA, 305 bp, Zea mays
gcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcagtcttctacgccactggagtaccca

SEQ ID NO: 590 - DNA, 295 bp, Zea mays
gggtccttcggtgctttggcccctcggagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttctccactgctttgacggcgagaacgtggagagtgctcctcctcctatgaagaaggactacaaactggctaatcttctatgctg

SEQ ID NO: 591 - DNA, 298 bp, Zea mays
gcgggagtgcttgatgagtaagacgggcttctggggtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgaacgtatggagaaatatctgtgaacccatttgtttatgaataagattgtttttt

SEQ ID NO: 592 - DNA, 320 bp, Zea mays
gcctcttgctgctgtgaagtactcccgcgggacgttcatctttcctggcgcacagccagccccccaccggagcttctccgaggaagttgctgtacttaaccgatactttgggggcctgaagtctggtggcaatgcttatgtgattggagatgcagcaagaccaggacagaagtggcacatctactacgccactgagtacccagagcaaccaatggtcaaccttgagatgtgcatgactggtctggacacgaagaaagcttcagtcttcttcaagactaatgctgatggcaacacaacatgtgccaaggaaatgacgaagt

SEQ ID NO: 593 - DNA, 284 bp, Zea mays
tggctactccatgaatgcgatccatggctctgcattctccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcg

SEQ ID NO: 594 - DNA, 285 bp, Zea mays
gaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctccatctccagcattgtgttctgattcacctgctccaatggctgttctttctgctgctgatgcttccccggtctcagctatcgggtttgagggctatgagaagcg

SEQ ID NO: 595 - DNA, 286 bp, Zea mays
agtagtcgttctatgatgtatgaagctccccttggctacagcattgaggacgttcgacctgccggagggtggaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctccatctccagcattgtgttctgattcacctg

SEQ ID NO: 596 - DNA, 289 bp, Zea mays
  unsure (1)..(289): unsure at all n locations
cttggctacagcattgaggacgttcgacctgccgganngtggaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctccatctccagcattgtgttctgattcacctgctccaatggctgttctttctgctgctgatgctt

SEQ ID NO: 597 - DNA, 281 bp, Zea mays
agccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctct

SEQ ID NO: 598 - DNA, 285 bp, Zea mays
gtcctctctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctgga

SEQ ID NO: 599 - DNA, 292 bp, Zea mays
cactgctttgtcttatggtgaccttgtcaagagggtcctccggtgctttggcccctcagagttttccgttgccgtgaccatcttcggcgggcgtggccatgccgggacatggggaaaggcacttggtgcagaggtctatgaactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctat

SEQ ID NO: 600 - DNA, 346 bp, Zea mays
  unsure (1)..(346): unsure at all n locations
ggccagccccccacaggagcttctctgagggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttctgtctttttcaagactaatgctgatgggaacacagcatgtgccaaggaaatgacaaagctctctggcatctctgaaatcatcccgagtggagnctgcgattgntttgaccctgtgctccaaatcaatgacntgtttt

SEQ ID NO: 601 - DNA, 282 bp, Zea mays
acttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttctgtctttttcaagactaatgctga

SEQ ID NO: 602 - DNA, 288 bp, Zea mays
  unsure (1)..(288): unsure at all n locations
caattgtgtccgagctctccaacaaggatttcgactcatatgtcctctctgagtcaagcttgtttatctatcctctgaagattatcntcaagacctgtggcactaccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctactttggcggcctgaaatctggtg

SEQ ID NO: 603 - DNA, 283 bp, Zea mays
gttccccagtcttgctccttgcactcctccctcctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctctccaacaaggatttcga

SEQ ID NO: 604 - DNA, 276 bp, Zea mays
gctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatccccgagatggagatctgcgat

SEQ ID NO: 605 - DNA, 281 bp, Zea mays
agaaggcgggagtgcttgatgagtaagacgggcttctggggtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgaacgtatggagaaatatctgtgaacccatttg

SEQ ID NO: 606 - DNA, 309 bp, Zea mays
acctgcaccaatggctgttctttctgctgctggtgctcccccggcctcagctatcgggtttgagggctatgagaagcgccttgagatcacattctctgaggcacctgtctttgtggacccccatggcagcggtttgcgtgccctctccaggtcccagattgactctgttctggatcttgcacggtgcacgatcgtgtccgagctctccaacaaggattttgactcctatgttctctccgagtcaagcttgttcatctatcctctgaagattgtcatcaagacctgtggcactaccaagctcctgctcac

SEQ ID NO: 607 - DNA, 276 bp, Zea mays
ggagggctatgagaagcgccttgagatcacattctctgaggcacctgtctttgtggaccctcatgggcgtggtttgcgtgccctctccagggcccagattgactctgttctggatcttgcacggtgcacaattgtgtctgagctctccaacaaggatttcgactcatatgtcctttctgagtcaagcttgtttatctatcctctgaagattgtcatcaagacctgtggcactaccaagctcctgctcaccattccaagaatccttgagcttgctga

SEQ ID NO: 608 - DNA, 282 bp, Zea mays
  unsure (1)..(282): unsure at all n locations
cttctctgctgggaggaggaagcggatgccatggaggagaaggcgngagtgcttgatgagtaagacgggcttctggggtcgatttgcttctgagttgtttattttcatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatga

SEQ ID NO: 609 - DNA, 274 bp, Zea mays
gcattctccacaatccatgtgacgcccgaggacggtttcagctacgccagttacgaggttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagtt

SEQ ID NO: 610 - DNA, 286 bp, Zea mays
  unsure (1)..(286): unsure at all n locations
ancaggggtttcacacatagcttcgtcgatttgaatttgatgtactaatggagtctaagggtggcaaaaagtctagcagtagtcgttctatgatgtatgaagctccccttggctacagcattgaggacgttcgacctgccggagggtgaagaagttccagtctgctgcttactccaactgcgcgaagaagccatcctgatatcccttttggcttcctcattctagtagtttaggatttcttttctgacactttgattctgaccaatctctctggcctgcngcttcc

SEQ ID NO: 611 - DNA, 324 bp, Zea mays
  unsure (1)..(324): unsure at all n locations
caaccaatggtnaaccttgagatgtgcatgactggtctggacaagaagaaagcttgtngccntttcaagactaatgctgatgggaacacaacatgtgccaaggaaatgacaaagctctctggcatctctgaaatcatccccgagatggagatctgcgattntgacttcgaaccctgtggctactccatgaatgcgatccatgggnnnnngaactccacaatccatgtgacgcccgaggacggtttcagctacgccagttacgaggttatgggctggatgccactgctctgctatggtgacctgtcaagagggncctccggtgct

SEQ ID NO: 612 - DNA, 282 bp, Zea mays
  unsure (1)..(282): unsure at all n locations
caatctctctggcctgctgcttcctgataatcgaccagttccccagtcttgctccttgcactcctccctccatctccagcattgtgttctgattcacctgctccaatggctgttctttctgctgctgatgcttcnccggnctcagctatcgggtttgagggctatgagaagcgccttgagatcacattctctgaggcacctgtctttgtggaccctcatgggcgtggtttgcgtgccctctccagggcccagatgactctgttctggatcttgcacggtgca

SEQ ID NO: 613 - DNA, 279 bp, Zea mays
  unsure (1)..(279): unsure at all n locations
cccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttgtgtctttttcaagactatgctgatgggaacacnacatgtgc

SEQ ID NO: 614 - DNA, 278 bp, Zea mays
  unsure (1)..(278): unsure at all n locations
gttctttctgctgctgatgcttccccggtctcagctatcgggtttgagggctatgagaagcgccttgagatcacattctctgaggcacctgtctttgtggaccctcatgggcgtggtttgcntgccctctccagggcccagattgactctgttctggatcttgcacggtgcacaattgtgtccgagcnctccaacaaggatttcgactcatatgtcctctctgagtcaagcntgtttatctatcctctgaagattgtcatcaagacctgtggcactac

SEQ ID NO: 615 - DNA, 279 bp, Zea mays
ctgcctggaggcgggctcctcgtgtaccagagcttctgtgctgctgaagacgctgttgctaccttcgcccaaatctgtattccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaatttcgtggttg

SEQ ID NO: 616 - DNA, 429 bp, Zea mays
  unsure (1)..(429): unsure at all n locations
cccacgcttacgnttcacgcgtccgcccacgcgtncgggnctnggnagattgtcatcaagacctgnggcactaccaagctcctgctcaccattccaagaatccttgagcttgctgaagagctgtctatgccacttgctgctgngaagtactcccgagggacgttcatntttcctggtgcacagncagcccnncacaggagcttctntgaggaagttgctgcacttaaccgctactttggcggcctgaaatctggtggtaatgcttatgtgattggagatccagcaagacctgnacagaagtggcaccgtcttctacnccactgaagtacccanagcaaaccaatggttaaccttgagatgtgcatgacttgntctggacaagaaagaaagcttntggctttttnaagactaatnctgatgggancaana

SEQ ID NO: 617 - DNA, 277 bp, Zea mays
gacaagaagaaagcttctgtctttttcaagactaatgctgatgggaacacagcatgtgccaaggaaatgacaaagctctctggcatctctgaaatcatccccgagatggagatctgcgattttgactttgaaccctgtggctactccatgaatgcgatccatggctctgcattctctacaatccatgtgacgcccgaggacggtttcagctatgccagttacgaggttatgggcttggatgccactgctctatcttatggtgaccttgtcaagaggg

SEQ ID NO: 618 - DNA, 473 bp, Zea mays
  unsure (1)..(473): unsure at all n locations
ggggngnacgtttattnccntgncccgtcaaaataacgggtcgaccacgcgtctngntnatcccccanatctgttttccactgctttgacggcgagaacgtggagagtgctcctcctctatgaagaaggactacaagctggctaatcttctctgctgggangaggaagcggatgccaggaggagaangcgggagtgcttgatgagtaagacgggcttctggggtcgatttgcttctagttgtttattttatatcgtcgcaatttcgtggttgtcgtttggttaatctgtgaagcaccaaaccaagctattgttaagaaaatttntcctccggtaaccagtnnaacttccaaagttccaaangcngggnttatcccnaaaaattnntntncnncccccacggnggggcanctgctntntcaaanatgagcatgaacttttggggaaaaaanatnttgggngcccannttttttt

SEQ ID NO: 619 - DNA, 264 bp, Zea mays
cttgcacggtgcacaattgtgtctgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgct

SEQ ID NO: 620 - DNA, 275 bp, Zea mays
gatgtgcatgactggtctggacaagaagaaagcttctgtctttttcaagactaatgctgatgggaacacagcatgtgccaaggaaatgacaaagctctctggcatctctgaaatcatccccgagatggagatctgcgattttgactttgaaccctgtggctactccatgaatgcgatccatggctctgcattctctacaatccatgtgacgcccgaggacggtttcagctatgccagttacgaggttatgggcttggatgccactgctctatctt

SEQ ID NO: 621 - DNA, 266 bp, Zea mays
  unsure (1)..(266): unsure at all n locations
gctgatgcttccccggtctcagctatcgggtttgagggctatgagaagcgccttgagatcacattctctgaggcacctgtctttgtggaccctcatgggcgtggtttgcntgccctctccagggcccagattgactctgttctggatcttgcacggtgcacaattgtgtctgagctctccaacaaggatttcgactcatatgtcctttctgagtcaagcttgtttatctatcctctgaagattgtcatcaagacctgtggcactac

SEQ ID NO: 622 - DNA, 278 bp, Zea mays
  unsure (1)..(278): unsure at all n locations
tgacgcccgaggacggtttcagctatgccagttacgaggttatgggcttggatgccactgctctancttatggtgaccttgtcaagagggtcctccggtgctttggcccctcggagttttccgttgccgtgaccatcttcggcgggcgtggccatgccgggacatggggaaaggcactaggtgcagaggtctatgactgcaacaacatggtggagcaggagctgcctggaggcgggctcctcgtataccagagcttctgcgctgctgaagacgctgtt

SEQ ID NO: 623 - DNA, 308 bp, Zea mays
  unsure (1)..(308): unsure at all n locations
cggggaatcaggggtttcacacatagcttcgtcgatttgaatttgatgtactaatggantctaagggtggcaaaaagtctagcagtagtcgttctatgatgtatgaagctccccttggctacagcattgaggacgttcgacctgccggagggtgaagaagttccagtctgctgcttactccaactgcggcgaagaagccatcctgatatcccttttggcttcctcattctagtagtttaggattctttctgacactttgattctgaccaatctctctggcctgctgttccggataatcgaccagttcc

SEQ ID NO: 624 - DNA, 402 bp, Zea mays
  unsure (1)..(402): unsure at all n locations
attntgaccaatctctctggcctgctgnttcctgataatcgaccagttccccagtctgggnccttncactcctccnncctccatctccagcattgtgttctgattcacctgctccaatggctgttctttctgctgctgatgcttccccggtctcagctatcgggtttgagggctatgagaagcgccttgagatcacattctctgaggcacctgtctttgtggacccttatgggcgtggtttgcgtgccctttncagggccnagattgactctgttntggatcttgnacgtnttcacanntgngtgngngcnanntaaaaggatntnntctnatatnntttntttanttangnntttnatnnnnntttaanttnnttntatnnttttntnttantaattnntt

SEQ ID NO: 625 - DNA, 407 bp, Zea mays
  unsure (1)..(407): unsure at all n locations
gngagangttnattaaggggatgggggggnngagnnatctnttttcggttcngaattcnggggncgacccacgcntccgatgcgatccatggctctgcattctccacaatccatgtgacgcccgaggacngtggnnngctatgccagttatgaggttatgggcttggatgccactgctctgtcttatggtgaccttgtcaagagggtccttcggtgctttggcccctcggagttttccgttgccgtgaccatcttcggcggncgtggccatgccgggacatggggaaaggcacttggtgcagaggtctatgactgcancaacatggtggagcagganctgcctggaggcggnctncnnnngtaccanancttntgngctnntnaanacnctnnnnnnannnnnnnna

SEQ ID NO: 626 - DNA, 273 bp, Zea mays
tatgaagctccccttggctacagcattgaggacgttcgacctgccggagggtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctccatctccagcattgtgttctgattcacctgctccaa

SEQ ID NO: 627 - DNA, 292 bp, Zea mays
catggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgctctgagttgtttatttatatcgtcgcaattcgtggttgt

SEQ ID NO: 628 - DNA, 311 bp, Zea mays
cctggcagtcctccctcctccatctccagcgttgtgttctgactcacctgcaccaatggctgttctttctgctgctggtgctcccccggcctcagctatcgggtttgagggctatgagaagcgccttgagatcacattctctgaggcacctgtctttgtggacccccatggcagcggtttgcgtgccctctccaggtcccagattgactctgttctggatcttgcacggtgcacgatcgtgtccgagctctccaacaaggattttgactcctatgttctctccgagtcaagcttgttcatctatcctctga

SEQ ID NO: 629 - DNA, 272 bp, Zea mays
  unsure (1)..(272): unsure at all n locations
agaaggcgggagtgcttgatgagtaagacgggcttctggggtcgatttgcttctgagttgnttattttatatcgtcgcaatttcncggttgtcgtttngttattctgtgaagcagccangccaggctattgttatgaaaatttgtcgtctgtaagcatgtgaacttccgatgttgccacatgctggatcagtctgaataagtaagtatgcngctctaggtggtcagctgcgtctnccacaatgagcatgaacgtatggagaaatatctgtga

SEQ ID NO: 630 - DNA, 272 bp, Zea mays
  unsure (1)..(272): unsure at all n locations
gagcttctgcgctgctgaagacgctgttgctacctcgcccaaatctgttttccactgctttgacggcgagaacgtggagagtgctcctcctcctatgaagaaggactacaaactagctaatcttctctgctggnaggaggaagcggatgccatggaggagaaggcgggagtncttgatgagtaagacgggcttctggtgtcgatttgcttctgagttgtttattttatatcgtcgcaatttcgtggttgtcgtttggttattctgtgaagca

SEQ ID NO: 631 - DNA, 263 bp, Zea mays
gcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaaga

SEQ ID NO: 632 - DNA, 272 bp, Zea mays
gacaagaagaaagcttctgtctttttcaagactaatgctgatgggaacacagcatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagctatgccagttatgaggttatgggcttggatgccactgctctgtcttatggtgaccttgtcaa

SEQ ID NO: 633 - DNA, 295 bp, Zea mays
  unsure (1)..(295): unsure at all n locations
ggctgttctttctgctgctgatgcntccccggtctcagnctatcgggtttgatggctatgagaagcgccttgagatcacattctctgaggcacctgtctttgtggaccctcatgggcgtggtttgcgtnccctctccagggcccagattgnctntgttctggatcttgcacggtgcacaatgtgtctgagctctccaacaaggatttcgactcatatgtcctttctgagtcaagcttgtttatctatcctctgaagattgtcatcaagacctgtncataccangctcctgctcac

SEQ ID NO: 634 - DNA, 292 bp, Zea mays
  unsure (1)..(292): unsure at all n locations
gattgtcatcaagacctgtggcactaccaagctcctgcttcaccattccaagaatccttgagcttgctgaagagctgtctatgccacttgctgctgtgangtaactcccgtgggacgttcatctttcctggcgcacagccagccccccacaggagcttctctgaggaagttgctgcacttaaccgctactttggcggcctgaaatctggtggtantgcttatgtgattggagatccagcaagacctggtcagaantggcacgtcttactacgccactgagtaaccagagcaa

SEQ ID NO: 635 - DNA, 270 bp, Zea mays
gtactaatggagtctaagggtggcaaaaagtctagcagtagtcgttctatgatgtatgaagctccccttggctacagcattgaggacgttcgacctgccggagggtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtct

SEQ ID NO: 636 - DNA, 270 bp, Zea mays
gatgtatgaagctccccttggctacagcattgaggacgttcgacctgccggagggtgaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctccttgcactcctccctccatctccagcattgtgttctgattcacct

SEQ ID NO: 637 - DNA, 267 bp, Zea mays
cagtcttgctccttgcactcctccctcctccatctccagcattgtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctctccaaca

SEQ ID NO: 638 - DNA, 281 bp, Zea mays
  unsure (1)..(281): unsure at all n locations
gcgggctcctcgtgtaccagagcttctgtgctgctgaagacgctgttgctacctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgtttattttatatcgtcgcaattcgtggntgtcgttggttattct

SEQ ID NO: 639 - DNA, 259 bp, Zea mays
attggagatccagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccctgtggctactccatgaatgcga

SEQ ID NO: 640 - DNA, 298 bp, Zea mays
  unsure (1)..(298): unsure at all n locations
cttgagatcacattctctgaggcacctgtctttgtggacccccatggcagcggtttgcgtgccctctccaggtcccagattgactctgttctggatcttgcacggtgcacgatcgtgtccgagctctccaacaaggattttgacncctatgttctctccgagtcaagcttgttcatctatcctctgaagattgtcatcaagacctgtggcactaccaagctcctgctcacaattccaaggatcctagagcttgctgaagagctgtctatncctcttgctgctgtgaagtactcccgcg

SEQ ID NO: 641 - DNA, 271 bp, Zea mays
  unsure (1)..(271): unsure at all n locations
ancgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttctgtcttttnccaagactaatgctgatgggaacacagcatgtgccaaggaaatgacaaagctctctggcatctctgaaatcatccccgagatggagatctgcgattttg

SEQ ID NO: 642 - DNA, 271 bp, Zea mays
ccaagacctgtggcactaccaagctcctgctcaccattccaagaatccttgagcttgctgacagagctgtctatgccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagt

SEQ ID NO: 643 - DNA, 273 bp, Zea mays
  unsure (1)..(273): unsure at all n locations
ggcccctcagagttttccgttnccgtgancatcttacggcnggcgtggccatgccgggacatggggaaaggcacttggtgcagaggtctatgactgcaacaacatggtggagcaggagctgcctggaggcgggctcntcgtgtaccagagcttctgtgctgctgaagacgctgttgctacctcgcccaaatctgttttccactgctttgacggcgagaacgtggagagtgctcctcctcctatgaagaaggactacaagctggctaatcttct

SEQ ID NO: 644 - DNA, 257 bp, Zea mays
gttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatc

SEQ ID NO: 645 - DNA, 310 bp, Zea mays
tcgctgcacgcgtacgtaagctcggaattcggctcgagggatttcgactcatatgtcctctctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgggacgttcatctttcctggtgcacagccagccccccacaggagcttctctgaggaagttgctgcacttaaccgctatttggggcctgaaatctggtggtaatgcttag

SEQ ID NO: 646 - DNA, 278 bp, Zea mays
  unsure (1)..(278): unsure at all n locations
agaaggcgggagtgcttgatgagtaagacgggnttctggggtcgatttgcttctgagttgtntattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaantatgcagctctaggtggtcagctgcgtctaccacaatgagcanngacntnntggagaaatatctgtgaacccc

SEQ ID NO: 647 - DNA, 257 bp, Zea mays
gagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcgatttgcttctgagttgttaattt

SEQ ID NO: 648 - DNA, 259 bp, Zea mays
ggctcctcgtgtaccagagcttctgtgctgctgaagacgctgttgctacctcgcccaaatctgttttccactgctttgacggcgagaacgtggagagtgctcctcctcctatgaagaaggactacaaactggctaatcttctatgctgggaggaggaagcggatgccatggaggagaaggcgggagtgcttgatgagtaagacgggcttctggggtcgatttgcttctgagttgtttattttatatcgtcgcaatttcg

SEQ ID NO: 649 - DNA, 259 bp, Zea mays
gggtccttcggtgctttggcccctcggagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctat

SEQ ID NO: 650 - DNA, 256 bp, Zea mays
gttatgggcttggatgccactgctctgtcttatggtgaccttgtcaagagggtcctccggtgctttggcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaat

SEQ ID NO: 651 - DNA, 267 bp, Zea mays
gctgatgggaacacagcatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagctatgccagttatgaggttatgggcttggatgccactgctctgtcttatggtgaccttgtcaagagggtccttcggtgctttggcccctcggag

SEQ ID NO: 652 - DNA, 531 bp, Zea mays
  unsure (1)..(531): unsure at all n locations
aggnnnnttgngatggggagaaaatgnatgcttntaccggtccggaattcccgggtcgacccacgcgtccggttgccaaagaattccctcccctagccgccgccgccgctcgtctccctgagaggtgccgggaccgaggatttggccgagttctaggtagagaatcggttttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgcccggaggcgtgaagaagttccagtctgctgcttactccaactgcgcgaagaagccatcctgatatcccttttggcttcctcattctagtagtttaggatttcttttctgacactttgattctgaccaaa

SEQ ID NO: 653 - DNA, 279 bp, Zea mays
  unsure (1)..(279): unsure at all n locations
gctccccttggctacagcattgaggacgttcgacctgccggatggtggaagaagttccagtctgctgcttactccaactgcgcgaagaagccatcctgntatcccttttggcttcctcattctagtagtttaggatttcttttctgacactttgattctgaccaatctctctgggcctgctgcttcctgataatcgaccagttccccagtcttgctccttgcatcctccctccatctccagcattgtgttctgattcacctgctccaatggctgttctt

SEQ ID NO: 654 - DNA, 488 bp, Zea mays
  unsure (1)..(488): unsure at all n locations
ttctttagccgnccnnctcacnacanagnctcgtnnntcnntacaanccnctanactaatcctnttagcgtggccatgccgggacatggggaaaggcacttggtgcagaggtctatgatgcaacaacatggtggagcangagctgcctggaggcgggctcctcntgtaccaaagctttgtnctgntgaagacgcngttgctanctcgcccaaatccgttttccantgntttgacnggaaaacnttganaatnctcctcctcctangaagaaagantacaaactggntaatcttctanctgggangaggaaacngattccnnggnngagaaagcgggagtgcctgatnngtattaaggnttctggggncnattttcgtctnagttngtannttttaagcntcccaanattccccgggtgtcnnnttgggggnntcnnnnngganannccccnnccccgntnttttntgaaaanttncccccnccgnnng

SEQ ID NO: 655 - DNA, 252 bp, Zea mays
  unsure (1)..(252): unsure at all n locations
gcgtggtttgcgtgccctctccagggcccagattgactctgntctggatcttgcacggtgcacaattgtgtctganctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagtactcccgtgg

SEQ ID NO: 656 - DNA, 282 bp, Zea mays
gcgggacgttcatctttcctggcgcacagccagccccccaccggagcttctccgaggaagttgctgtacttaaccgatactttgggggcctgaagtctggtggcaatgcttatgtgattggagatgcagcaagaccaggacagaagtggcacatctactacgccactgagtacccagagcaaccaatggtcaaccttgagatgtgcatgactggtctggacacgaagaaagcttcagtcttcttcaagactaatgctgatggcaacacaacatgtgccaagg

SEQ ID NO: 657 - DNA, 250 bp, Zea mays
atcaagacctgtggcactaccaagctcctgctcaccattccaagaatccttgagcttgctgaagagctgtctatgccacttgctgctgtgaagtactcccgtgggacgttcatctttcctggcgcacagccagccccccacaggagcttctctgaggaagttgctgcacttaaccgctactttggcggcctgaaatctggtggtaatgcttatgtgattggagatccagcaagacctggacagaagtggc

SEQ ID NO: 658 - DNA, 261 bp, Zea mays
gtctttgtggacctcatgggcgtggtttgcgtgccctctccagggcccagattgactctgttctggatcttgcacggtgcacaattgtgtctgagctctccaacaaggatttcgactcatatgtcctttctgagtcaagcttgtttatctatcctctgaagattgtcatcaagacctgtggcactaccaagctcctgctcaccattccaagaatccttgagcttgctgaagagctgtctatgccacttgctgctgtgaagt

SEQ ID NO: 659 - DNA, 261 bp, Zea mays
  unsure (1)..(261): unsure at all n locations
gcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaatcatcccngagatggagatctgcgatttngacttcgaaccctgnggctactccatgantgcgatccatggctctgcat

SEQ ID NO: 660 - DNA, 454 bp, Zea mays
caaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtaagtttaggatttcttttctgacactttgattctgaccca

SEQ ID NO: 661 - DNA, 248 bp, Zea mays
ccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgc

SEQ ID NO: 662 - DNA, 295 bp, Zea mays
ctgagatggagatctgtgattttgacttcgaaccctgcggctactccatgaatgcaatccatggctctgcgttctccacgatccatgtgacgcctgaggatgggttcagctacgccagttatgaggttatgggcttggatgccactgccctgtcttacggtgaccttgtcaagagggtccttgggtgcttcggcccctcggaattttctgtcgccgtgaccatcttcggcgggcggggccaagctgggacatggggaaaggaacttggtgcggaggcttatgactgcaacaacat

SEQ ID NO: 663 - DNA, 247 bp, Zea mays
  unsure (1)..(247): unsure at all n locations
catggtggagcaggagctgcctggaggcgggctcctcgtgtaccagagcttctgtgctgctgaagacgctgttgctacctcgcccaaatctgttttccactnctttgacggcgagaacgtggagagtgctcctcctcctatgaagaaggactacaagctggctaatcttctctgctgggaggaggaagcggatgccatggaggagaaggcgggagtgcttgatgagtaagacgggcttctggggtcg

SEQ ID NO: 664 - DNA, 254 bp, Zea mays
  unsure (1)..(254): unsure at all n locations
tcctggcgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagnnagcttgtggtcttttcaagactaatgctgatgggaacacaa

SEQ ID NO: 665 - DNA, 253 bp, Zea mays
gtttcagctatgccagttatgaggttatgggcttggatgccactgctctgtcttatggtgaccttgtcaagagggtccttcggtgctttggcccctcggagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctga

SEQ ID NO: 666 - DNA, 248 bp, Zea mays
ctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggtctggacaagaagaaa

SEQ ID NO: 667 - DNA, 291 bp, Zea mays
  unsure (1)..(291): unsure at all n locations
gtgttctgattcacctgctccaatggctgttctttctgctgctgatgcttccccggtctcagctatcgggtttgagggctatgagaagcgccttgagatcacattctctgaggcacctgtctttgtggaccctcatgggcgtggtttgcntgccctctccagggcccagattgactctgttctggatcttgcacggtgcacaattgtgtctgagctctccaacaaggattcgatcatagtccttnctgantnagcttgtttaactatcctctgaagatgtcatcaagactg

SEQ ID NO: 668 - DNA, 247 bp, Zea mays
  unsure (1)..(247): unsure at all n locations
tgcttatgtgattggagatccagcaagacctggacagaagtggcacgacttctacgccaangagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccc

SEQ ID NO: 669 - DNA, 445 bp, Zea mays
  unsure (1)..(445): unsure at all n locations
ctcccctagccgccgccnccgctcgtctntntgngaggtgccgggaccgaggatttggnngagttctaggtagagaatcggntttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacnttcgacctgccngaggcgtgaaaaanttccagtctgntgcttactncaactgnncnaaaaaaccatnctgatatcccttttggcttcctcattctagtagtttaagatttcttttctgacactttgattctgaccaatct

SEQ ID NO: 670 - DNA, 276 bp, Zea mays
  unsure (1)..(276): unsure at all n locations
ttgtgttctgattcacctgctccaatggctgttctttctgctgctgatgcttccccggtctcanctatcgggtttgagggctatgagaagcgccttgagatcacattctctgaggcacctgtcttgtggaccctcatgggcgtggtttgngtgcnctctccagggnccagattgactctgttctggatcttgcacggtgcacaatgtgtccgagctctccaacaaggatttcgactcanatgtcctcctctgagtcaagcntgtntatctatccnc

SEQ ID NO: 671 - DNA, 283 bp, Zea mays
  unsure (1)..(283): unsure at all n locations
tctaagggtggcaagaagtctagcagtagtcgttccatgatgtatgaagctccccttggctacagcattgaggacgttcgacctgccggagggcgaagaagttccagtctgctgcttactccaactgcgcaaagaagccatcctgatatcccttttggnttcctcgttctagtagtttaggatttcttttctgacacttcgnttcttaccaatccccctggcctgctgctttcctgacaatcgaccagttccccagtcttgctccctgcagtcctccctcctc

SEQ ID NO: 672 - DNA, 284 bp, Zea mays
  unsure (1)..(284): unsure at all n locations
gacactttgattctgnnccaatctctctggcctgctgcttcctgataatctnnccagtttccccagtcttgctccttngagctcctccctccatctccagcattgtgttctgattcacctgctccaatggctgttctttctgctgctgatgttccccggtctcagctatcgggtttgagggctatgagaagcgccttgagatcacattctctgaggcacctgtctttgtggaccctcatgggcgtggtttgcgtgccctctcaagggcccagattgactctgtt

SEQ ID NO: 673 - DNA, 443 bp, Zea mays
  unsure (1)..(443): unsure at all n locations
ggaggaagcggatgccatggangagantgcgggagtgcttgatgagtaagacggacnggngaggtgcgatttgcttctgagttggttattttatatcgtcgcaatttcgtggttgtcgtttggttattctgngaagcanccaagccaggctattgntatgaaaatttgtcgtntgtaagcatgtgaacttncgatgttgccacatgctggatcagtctgaataagtaagtatgcagctctaggtggtcagntgngtntaccacaatgagcatgaactgtatggagaaatatntgtgaacccattttggntatgaattacaannngctttttngaaaaaanaatactggcggnntntgttcaanaaatggttttgagctttnnctttngtatcttttttgaagaaccggtctaattgacgcttaaattcncatggagtggtnaa

SEQ ID NO: 674 - DNA, 254 bp, Zea mays
  unsure (1)..(254): unsure at all n locations
ccgttgccgtgaccatcttcggcgggcgtggccatgccgggacatggggtnaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggatacaagctggctaatcttc

SEQ ID NO: 675 - DNA, 272 bp, Zea mays
ctgaagtctggtggcaatgcttatgtgattggagatgcagcaagaccaggacagaagtggcacatctactacgccactgagtacccagagcaaccaatggtcaaccttgagatgtgcatgactggtctggacacgaagaaagcttcagtcttcttcaagactaatgctgatggcaacacaacatgtgccaaggaaatgacgaagctctctggtatctctgaaattatccctgagatggagatctgtgattttgacttcgaaccctgcggcta

SEQ ID NO: 676 - DNA, 240 bp, Zea mays
atccagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccctgtggctact

SEQ ID NO: 677 - DNA, 243 bp, Zea mays
  unsure (1)..(243): unsure at all n locations
gctgctgtgaagtactcccgtgggacgttcatctttcctggcgcacagccagccccccacaggagcttctctgaggaagttgctgcacttaaccgctactttggcggcctganatctggtggtaatgcttatgtgattggagatccagcaagacctggacagaagtggcacgtcttctacgccactgagtacccagagcaaccaatggttaaccttgagatgtgcatgactggtctggacaag

SEQ ID NO: 678 - DNA, 243 bp, Zea mays
  unsure (1)..(243): unsure at all n locations
ggtgaccttgtcaagagggtcctccggtgctttngcccctcagagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgac

SEQ ID NO: 679 - DNA, 251 bp, Zea mays
ggggtttcacacatagcttcgtcgatttgaatttgatgtactaatggagtctaagggtggcaaaaagtctagcagtagtcgttctatgatgtatgaagctccccttggctacagcattgaggacgttcgacctgccggagggtgaagaagttccagtctgctgcttactccaactgcgcgaagaagccatcctgatatcccttttggcttcctcattctagtagtttaggatttcttttctgacactttga

SEQ ID NO: 680 - DNA, 268 bp, Zea mays
cacaattccaaggatcctagagcttgctgaagagctgtctatgcctcttgctgctgtgaagtactcccgcgggacgttcatctttcctggcgcacagccagccccccaccggagcttctccgaggaagttgctgtacttaaccgatactttgggggcctgaagtctggtggcaatgcttatgtgattggagatgcagcaagaccaggacagaagtggcacatctactacgccactgagtacccagagcaaccaatggtcaaccttgag

SEQ ID NO: 681 - DNA, 249 bp, Zea mays
  unsure (1)..(249): unsure at all n locations
gctgatgggaacacagcatgtgccaaggaaatgacaaagctctctggcatctctgaaatcatccccgagatggagatctgcgattttgactttgaaccctgtggctactccatgaatgcgatccatggctctgcattctccacaatccatgtgacgcccgaggacggtttcagcnatgccagttatgaggttatgggcttggatgccactgctctgtcttatggtgaccttgtcaagagggtccttcgg

SEQ ID NO: 682 - DNA, 241 bp, Zea mays
gccacttgctgctgtgaagtactcccgtgggacgttcatctttcctggtgcacagccagccccccacaggagcttctctgaggaagttgctgcacttaaccgctactttggcggcctgaaatctggtggtaatgcttatgtgattggagatccagcaagacctggacagaagtggcacgtcttctacgccactgagtacccagagcaaccaatggttaaccttgagatgtgcatgactggt

SEQ ID NO: 683 - DNA, 268 bp, Zea mays
  unsure (1)..(268): unsure at all n locations
gtctttttcaagactaatgctgatgggaacacaacatgtgccaaggaaatgacaaagctctctggcatctctgaaatacatccccgagatggagatctgcgattttgacttcgaaccctgtggctactccatgaatgcgatccatggctctgcattctccacaatccatgtgacgcccgaggacggtttcagctacgccagttacgaggttatgggctntanttgccatgctctgtcttatggtgaccttgtcaagaggtcctccggt

SEQ ID NO: 684 - DNA, 264 bp, Zea mays
  unsure (1)..(264): unsure at all n locations
tgttttccactgctttgacggcgagaacgtggagagtgctcctcctcctatgaagaaggactacaaactagctaatcttctctgctgnnnggaggaagcggatgccatggaggagaaggcgggagtgcttgatgagtaagacgggcttctggtgtcgatttgcttctgagttgtttattttatatcgtcgcnatttcgtggttgtcgtttggttatctgtgaagcagccaagccaggctattgttatgaaaattgtcgtctgta

SEQ ID NO: 685 - DNA, 268 bp, Zea mays
  unsure (1)..(268): unsure at all n locations
agcaagacctgggacagaagtggcacnntcttctacgccactgagtacccagagcaaccaatggttaaccttgagatgtgcatgactggtctggacaagaagaaagcttgtgtctttttcaagactaatgctgatgggaacacaacatgtgccaaggantganaancctctctggcatctctgaaatcatccccgagatggagatctgcgattttgacttcgaaccctgtggctactccatgaatgcgatccatggctctgcattctc

SEQ ID NO: 686 - DNA, 332 bp, Zea mays
  unsure (1)..(332): unsure at all n locations
ttttccctgctttgacggcgagcaacgtgganagtgctctncctcctatgaagaangnctacanactggctaatcttctatnctnggacgnnganncggatgcccatggnaggagaaggcgggagtgcttgatgagtaanacgggcttctggggtcgatttgcttctgagttgtttattttatatcgtcgcaatttcgtggttgtcgtttngttattctgtgaagcagccaagccaagctattgttatganntttgtcgtctgtaagcatgtgacttccgccgttgccacatgctggatcagtctgaatagtaagtngcagctctagtggnc

SEQ ID NO: 687 - DNA, 237 bp, Zea mays
  unsure (1)..(237): unsure at all n locations
gaagcggatgccatggnggagaaggcgggagtgcttgatgagtaagacgggcttctggggtcgatttgcttctgagttgtntattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctag

SEQ ID NO: 688 - DNA, 286 bp, Zea mays
  unsure (1)..(286): unsure at all n locations
cagcattgtgttctgattcacctgnctccaatggctgttgctttctgctgctgatgcttccccggtctcagctatcgggtttgagggctatgagaagcgccttgagatcacattctctgaggcacctgtctttgtggaccctcatggcgtggtttgcgtgccctctccagggcccagattgactctgttctggatcttgcacggtgcacaatgtgtccgagctctccaacaaggatttcgactcatagtcctctctgagtcaagcttgtttatctatctctgaaga

SEQ ID NO: 689 - DNA, 300 bp, Zea mays
  unsure (1)..(300): unsure at all n locations
gncgtgcnanctcgggaatcaggggtttcacacatagcttcgtcgatttgaatttnatgtactaatggagtctaagggtggcaaaaagtctagcagtagtcgttctatgatgtatgangctccccttggctacagcnttgaggacgttcgacctgccggacggtgaagaagttccagtctgctgcttactccaagtgcgcgangaagccatcctgatatccttttggcttccctcattctagtagtttangatttcntttctgacactttgattntgaccantctctnctgggcttgntg

SEQ ID NO: 690 - DNA, 278 bp, Zea mays
  unsure (1)..(278): unsure at all n locations
gtgattggaggccgccaaagtagcggntaagtgcagcaacttcctnagagaagctcctgtggggggctggctgtgcaccaggaaagatgaacgtcccangggagtacttcacagcagcnagtggcatagacagctcttcagcaagctcaaggattcttggaatggtgagcaggacttggtagtgccacaggtcttgatgacaatcttcagaggatagatnaacaagcttgactcatagaggacatatgatccgaaatccttgtggagagctcgacaca

SEQ ID NO: 691 - DNA, 525 bp, Zea mays
  unsure (1)..(525): unsure at all n locations
gnnaantgttttgtaangggggggnnaangnnaagcttttaccggtccggaattcccgggtcgacccacgcgtccgcaaagaattccctcccctagccgccgccgccgccgctcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgcgaagaaccatcctgatatcccttttggcttnctcattctagtagtttaaggattcttttntgacactttgaattt

SEQ ID NO: 692 - DNA, 242 bp, Zea mays
gcatgactggtctggacaagaagaaagcttgtgtctttttcaagactaatgctgatgggaacacaacatgtgccaaggaaatgacaaagctctctggcatctctgaaatcatccccgagatggagatctgcgattttgacttcgaaccctgtggctactccatgaatgcgatccatggctctgcattttcaaaatccatgtgacgcccgaggacggtttcagctacgccagttacgaggtta

SEQ ID NO: 693 - DNA, 238 bp, Zea mays
caaatcttattcataaacaaaatgggttcacagatatttctccatacgtacatgctcattgtggtagacgcagctgaccacctagagctgcatacttacttattcagactgatccagcatgtggcaacgtcggaagttcacatgcttacagacgacaaattttcataacaatagcttggcttggctgcttcacagaataaccaaacgacaaccacgaaattgcgacgatataaaataa

SEQ ID NO: 694 - DNA, 263 bp, Zea mays
  unsure (1)..(263): unsure at all n locations
cgctactttggcggcctgaaatctggtggtaatgcttatgtgattggagntccagcaagacctggacagangtggcacgtcttctacgccactgagtacccagagcaaccaatggttaaccttganatgngcatgactggtctggacnagnagaangcttgtgtctttttcaagantaatgctgatgggnacacnacatgtgccaagggaatgacnaagctcnctggcatctcngaaagcntncccgngatggannntgcgnt

SEQ ID NO: 695 - DNA, 245 bp, Zea mays
atgccactgctctgtcttatggtgaccttgtcaagagggtccttcggtgctttggcccctcggagttttccgttgccgtgaccatcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctactcgcccaaatctg

SEQ ID NO: 696 - DNA, 229 bp, Zea mays
gctgctgatgcttccccggtctcagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtctgagctctccaacaaggatttcgactcatatgtcctttctgagtcaagcttgttta

SEQ ID NO: 697 - DNA, 228 bp, Zea mays
  unsure (1)..(228): unsure at all n locations
tcttcggcgggcgtggccatgccgggacatggggaaaggcacttggtgcagaggtctatgactgcaacaacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacangc

SEQ ID NO: 698 - DNA, 227 bp, Zea mays
caacatggtggagcaggagctgcctggaggcgggctcctcgtgtaccagagcttctgtgctgctgaagacgctgttgctacctcgcccaaatctgttttccactgctttgacggcgagaacgtggagagtgctcctcctcctatgaagaaggactacaagctggctaatcttctctgctgggaggaggaagcggatgccatggaggagaaggcgggagtgcttgatg

SEQ ID NO: 699 - DNA, 275 bp, Zea mays
gtgattttgacttcgaaccctgcggctactccatgaatgcaatccatggctctgcgttctccacgatccatgtgacgcctgaggatgggttcagctacgccagttatgaggttatgggcttggatgccactgccctgtcttacggtgaccttgtcaagagggtccttgggtgcttcggcccctcggaattttctgtcgccgtgaccatcttcggcgggcggggccaagctgggacatggggaaaggaattggtgcggaggcttatgactgcaaca

SEQ ID NO: 700 - DNA, 497 bp, Zea mays
  unsure (1)..(497): unsure at all n locations
gnnnnnnggngtttganangggggggggaagnnnaancttntaccnggtccggaattcccgggtcgacccacgcgtccgccaaagaattccctcccctaccgccgtcgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtctgctgcttactccaactgcgcgaagaagccatcctgatatcccttttggcttcctcattctagtagtt

SEQ ID NO: 701 - DNA, 244 bp, Zea mays
ctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggagggtgaagaagttccagtctgctgcttactccaactgcgcgaagaagccatcctgatatcccttttggcttcctcattctagtagtttaggatt

SEQ ID NO: 702 - DNA, 292 bp, Zea mays
  unsure (1)..(292): unsure at all n locations
gncgtgcgagctcgggaatcaggggtttcacacatagcttcgtcgatttgaatttnatgtactaatggagtctaagggtggcaaaaagtctagcagtagtcgttctatgatgtatgaagctccccttggctacagcattgaggacgttcgacctgccggagggtgaaagaanttccagtctgctgcttactccaactgcgcgaagaagccatcctgatanccctttnggcttcctcattncnagtagttnaggttccttttctgacatttgattctgaccaatctcggnggg

SEQ ID NO: 703 - DNA, 225 bp, Zea mays
cagctatcgggtttgagggctatgagaagcgccttgagatcacattctctgaggcacctgtctttgtggaccctcatgggcgtggtttgcgtgccctctccagggcccagattgactctgttctggatcttgcacggtgcacaattgtgtccgagctctccaacaaggatttcgactcatatgtcctctctgagtcaagcttgtttatctatcctctgaagattg

SEQ ID NO: 704 - DNA, 289 bp, Zea mays
  unsure (1)..(289): unsure at all n locations
cagttccccagtcttgntccctgcagtcctccctcctccatctccagcgttgtgttctgactcacctgcaccaatggctgttctttctgctgctggtgctcccccggcctcagctatcgggtttgagggctatgagaagcgccttgagatcacattctctganncacctgtctttgtggacccccatggcagcggtttgcgtgccctctccaggtcccagattgactctgttctggatcttgcacggtgcacgatcgtgtccgagctctccaacaaggatttgactcct

SEQ ID NO: 705 - DNA, 257 bp, Zea mays
  unsure (1)..(257): unsure at all n locations
gaatccttgagcttgctgaagagctgtctatgccacttgctgntgtgaagtactcccgtgggacgttcatctttcctggcgcacagccagccccccacaggagcttctctgaggaagtgctgcacttaaccgctactttggcgggctgaaatctggtggtaatgcttatgtgattggagatccagcaagaacctggacagaagtggnacgtcttctaacgcaactgagtaccnagagcaaccaatggttaccttgag

SEQ ID NO: 706 - DNA, 221 bp, Zea mays
  unsure (1)..(221): unsure at all n locations
atgaagctccccttggctacagcattgaggacgttcgacctgccggagggtngaagaagttccagtctgctgcttactccaactgcgcgaagaagccatcctgatatcccttttggcttcctcattctagtagtttaggatttcttttctgacactttgattctgaccaatctctctggcctgctgcttcctgataatcgaccagttccccagtcttgctc

SEQ ID NO: 707 - DNA, 534 bp, Zea mays
  unsure (1)..(534): unsure at all n locations
gggnnnaggtgtttctgtaanggnnaaannatgganatgctctaccggtccggaattcccgggtcgacccacgcgtccggttgccaaagaattccctcccctagcccgncgccgccgctcgtctccctgagaggtgccgggancgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaagttccagtcttgcttgcttactccaactgcgcgaagaagccatcctgatatcccttttggtttcctaatttnannantttaggaattnttttttgaaaccttnnannt

SEQ ID NO: 708 - DNA, 253 bp, Zea mays
  unsure (1)..(253): unsure at all n locations
gatttcttttctgacactttgattctgaccaatctctctggcctgcngcttcctgataatcgaccagttccccagtcttgctccttgcactcctccctccatctccagcattgtgttctgattcacctgctccaatggctgttctttctgctgctgatgcttccccggtctcagctatcgggnttgagggctatgagaagcgcctgagatcacattctctgaggnactgtcttngtggancncanggcggggg

SEQ ID NO: 709 - DNA, 301 bp, Zea mays
  unsure (1)..(301): unsure at all n locations
gcattgaggacgttcgacctgccggagngcgaagaagttccagtctgctgcttactccaactgcgcaaagaagccatcctgatatcccttttggctttctcgttctagtagtttaggatttcttttctgacacttcgattcttaccaatccccctggcctgctgctttcctgacaatcgaccagttccccagtcttgctccctgcagtcctccctcctccatctccagcgttgtgttctgactcacctgcaccaatggctgttctttctgctgctggtgctcccccggcctcagctatcgg

SEQ ID NO: 710 - DNA, 261 bp, Zea mays
  unsure (1)..(261): unsure at all n locations
tgaaganctgtctatgcctcttgctgctgtgaagtactcccgcgggacgttcatctttcctggcgcacanccagccccccaccggancttctccgaggaagttgctgtacttaancgatactttgggggcctgaagtctggtggcaatgcttatgtgattgnagatgcagcaagaccaggacagaantngcacatctactacgccactgagtacccagagcaancaatggtcaaccttgagatgtaaanannggnttttnc

SEQ ID NO: 711 - DNA, 252 bp, Zea mays
gtgattttgacttcgaaccctgcggctactccatgaatgcaatccatggctctgcgttctccacgatccatgtgacgcctgaggatgggttcagctacgccagttatgaggttatgggcttggatgccactgccctgtcttacggtgaccttgtcaagagggtccttgggtgcttcggcccctcggaattttctgtcgccgtgaccatcttcggcgggcggggccaagctgggacatggggaaaggaattgg

SEQ ID NO: 712 - DNA, 263 bp, Zea mays
gttccccagtcttgctccctgcagtcctccctcctccatctccagcgttgtgttctgactcacctgcaccaatggctgttctttctgctgctggtgctcccccggcctcagctatcgggtttgagggctatgagaagcgccttgagatcacattctctgaggcacctgtctttgtggacccccatggcagcggtttgcgtgccctctccaggtcccagattgactctgttctggatcttgcacggtgcacgatcgtgtccgag

SEQ ID NO: 713 - DNA, 266 bp, Zea mays
  unsure (1)..(266): unsure at all n locations
gaaggcgggagtgcttgatgagtaagacgggcntctggggtcgatttgcttctgagttgtntannttatatcgtcgcaattncncggttgtcgtttngtnattctgtgaagcagccncgccaggctattgttatgaaaattgtcgtctgtaagcatgtgaacttccgatgttgccacatgctggancatctgaataagtaagtangnngctctaggtagtcagctgcgtctncccacaatgagcatgaagtatggagaaatatctg

SEQ ID NO: 714 - DNA, 242 bp, Zea mays
  unsure (1)..(242): unsure at all n locations
cngcgattttnactttgaaannngtggctactccannaatgcgatccatggctcagnattctccacaatccatgtgacgcccgaggacggtttcagctatgccagttatgaggttatgggcttggatgccactgctctgtcttatggtgaccttgtcaagagggtcctcggtgctttggcccctcggagttttccgttgccgtgaccatcttcggcgggcgtggccagccgggaacatggga

SEQ ID NO: 715 - DNA, 257 bp, Zea mays
  unsure (1)..(257): unsure at all n locations
cagctatcgggtttgagggctatgagangcgccttgagatcacattctctgaggcacctgtactttgtggacccccatggcagcggtttgcgtgccctctccaggtcccagattgactctgttctggatcttgcacggtgcacgatcgtgtccgagctctccaacaaggattttgantcctatgttctctccgagtcaagcttgttcatctatcctctgaagattgtcatcaagacctgtggcataccaagctcctg

SEQ ID NO: 716 - DNA, 326 bp, Zea mays
  unsure (1)..(326): unsure at all n locations
ctcagctatcgggtttgagggctatgagaagcgccttgagatcacattctctgaggnacctgtctttgtngnccctcatgggcgtggtttgcgtgncctctccagggnccagattgacnctgttcnggatcttgcanggtgnacaattgngnccgagctctccaacaaggatttcgactcnatgtcctctctgagtcaanttgnttatctatcctctgaagattgtcatcaagacctgtggcatancaagctcctgtcancatcnaagaatcctgagctgctgaagagctgtctagccattgctnctgtgantatccgtgggagtc

SEQ ID NO: 717 - DNA, 496 bp, Zea mays
  unsure (1)..(496): unsure at all n locations
gncnntgnntnggggngnnggtaatgntactgccgtaccggtccggaattcccgggtcgacccacgcgtccggttgccaaagaattccctcccctagccgccgccgccgctcgtctccctgagaggtgccgggaccgaggatttggccgagttctaggtagagaatcggttttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgcgaagaaccatcctgatatcccttttggcttctcattctaagtanttta

SEQ ID NO: 718 - DNA, 237 bp, Zea mays
gtcgcaatttcgtggttgtcgtttggttattctgtgaagcagccaagccaagctattgttatgaaaatttgtcgtctgtaagcatgtgaacttccgacgttgccacatgctggatcagtctgaataagtaagtatgcagctctaggtggtcagctgcgtctaccacaatgagcatgtacgtatggagaaatatctgtgaacccattttgtttatgaataagatttgttttttcgagt

SEQ ID NO: 719 - DNA, 493 bp, Zea mays
  unsure (1)..(493): unsure at all n locations
acctnctccngaattcccgggtcgacccangcgtgcgcgggacccgaggaactggccgagttctaggtagagaatcggttttgcttgtctcagcacggngtgtgnggngtctggtggtggngaaggggagaaattcgtgagatctgttccggatcaggcgtncgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccggaggcgtgaagaanttccagtctgctgcttactccaactgcgcgaaaaaaccatcctgatatcccttttggctttcctcaatctaatantttaaggatttctttttttgacacttttaattcttaccaaatnttttttggcctggntgctttcctganaaatngaccanttccccannt

SEQ ID NO: 720 - DNA, 264 bp, Zea mays
  unsure (1)..(264): unsure at all n locations
tgctttgacggcgagaacgtggagagtgctcctcctcctatgaagaaggactacaaactggctaatcttctctgctgggaggaggaagcggatgccatggaggagaaggcgggagtgcttgatgagtaagacgggcttctggtgtcgatttgcttctgagttgtttattttatatcgtcgcaatttcgtggttgtcgtttggttatccgtgaagcacccagccagcnaatgttagnaaatttgccgccgtaaccagggaacttc

SEQ ID NO: 721 - DNA, 272 bp, Zea mays
  unsure (1)..(272): unsure at all n locations
caggcgtgcgagctcgggaatcaggggtttcacacatagcttcgtcgatttgaatttgatgtactaatggagtctaagggtggcaaaaagtctagcagtagtcgnntccatgatgtatgaagctccccttggctacagcattgaggacgttcgacctgccggagggtgaaagangttccagtcngcngcttactccaactgcgnnaagaagcccattcctgatatccctttnggcttccncattctagtaggttaggattncttttctnaca

SEQ ID NO: 722 - DNA, 487 bp, Zea mays
  unsure (1)..(487): unsure at all n locations
ttatntnccantgnccgnctcaaatacanagncncgtnnttcattacaanncnnnnnnnnnnnnnnnnnnnnncaaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccgggaggcgtgaagaagttccagtctgctgcttactccaactgcgcgaaagaagccatcctgatatcccttttggcttcctcaatcta

SEQ ID NO: 723 - DNA, 271 bp, Zea mays
  unsure (1)..(271): unsure at all n locations
tttgttgatttgactatggaacataaggnggagatgaaggttgtggtcaggacagttatttcactcaccaaggaggaagcggatgccatggaggagaaggcgggagtgcttgatgagtaagacgggcttctggtgtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgcc

SEQ ID NO: 724 - DNA, 214 bp, Zea mays
  unsure (1)..(214): unsure at all n locations
ctctctggcatctctgaaatcatccccgagatggagatctgcgattttgactttgaaccctgtggctactccatgaatgcgatccatggctctgcattctccacaatccatgtgacgcccgaggacggtttcagctatgccagttatgaggttatgggcttggatgccactgctctgtcttatggtgaccttgtcaagagggtcntcggtgttg

SEQ ID NO: 725 - DNA, 260 bp, Zea mays
caatcgaccagttccccagtcttgctccctgcagtcctccctcctccatctccagcgttgtgttctgactcacctgcaccaatggctgttctttctgctgctggtgctcccccggcctcagctatcgggtttgagggctatgagaagcgccttgagatcacattctctgaggcacctgtctttgtggacccccatggcagcggtttgcgtgccctctccaggtcccagattgactctgttctggatcttgcacggtgcac

SEQ ID NO: 726 - DNA, 536 bp, Zea mays
  unsure (1)..(536): unsure at all n locations
gagaaantggcttccttntagnagnnncnnangganagnnttctatcctntcgnanttcccgnatgngaccgacgcgtccgcaangaattccctcccctagccgccgcntccgtcgctcgtctccctgagaggtgccgggncnggggaactggccgagtactaggtagagaatcggtttttcttgtctcagcccggggtctgctgcgtctggtggtggtgaaggggagaaattcgtgagatctgttccggatcaggcgtgcgagctcgggaatcangggtttcacacatagcttcgtcgatttgaatttgatgtactaatggagtctaagggtggcaaaaagtctagcagtagtcgttctatgatgtatgaagctncccttggctacagcattgaggaccgttcgacctgccggangcgtgaagaagttccagtctnctgcttacttcaactgcccnaagaagccatcctnatannccttttggctttcttattctaatagntttangatttctttttctganacccnntattttt

SEQ ID NO: 727 - DNA, 456 bp, Zea mays
  unsure (1)..(456): unsure at all n locations
caaagnattcnctcccctagccgccgccgccgctcgnctccctgagaggtgccgggaccgaggatttggccgagttctaggtagagaatcggttttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgangacgttcgacctgccngangcgtgaagaaattncaagtctgctgcttactccaactgcgccaaaaaaccatnctgatattccttttggctttcctaatctagtaagttaaggatttcttttctgacacttttgaatctgancca

SEQ ID NO: 728 - DNA, 196 bp, Zea mays
ggtgtcgatttgcttctgagttgtttattttatatcgtcgcaatttcgtggttgtcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtc

SEQ ID NO: 729 - DNA, 218 bp, Zea mays
gattgactctgttctggatcttgcacggtgcacgatcgtgtccgagctctccaacaaggattttgactcctatgttctctccgagtcaagcttgttcatctatcctctgaagattgtcatcaagacctgtggcactaccaagctcctgctcacaattccaaggatcctagagcttgctgaagagctgtctatgcctcttgctgctgtgaagtactccc

SEQ ID NO: 730 - DNA, 261 bp, Zea mays
  unsure (1)..(261): unsure at all n locations
tggnntgtaatnctnnctncacagccagtaccanaccaaantangnccngacnacncaccnaccgnctctgtcttatggtgaccttgtcaagagggtcctccggtgctttggcccctcgagttttccgttgccgtgaccatcttcggcgggcgtggccatgccgggacatggggaaagcacttggtgcagaggtctatgactgcaacaacatggtggagcaggagctgcctggagggggctcctcgtgtaccagagctnac

SEQ ID NO: 731 - DNA, 306 bp, Zea mays
  unsure (1)..(306): unsure at all n locations
atcaggggtttcacacatagcttcgtcgatttgaatttgatgtactaatggagtctaagggtggcaaaaagtctagcagtagtcgtctatgatgtatgaagctccccttggctacagcattgaggacgttcgacctgccggagngtgaagaagttccagtctgctgcttactccaactgcgcgaagaagccatcctgatatcctttggcttcctcatctagtagtttaggattctttctgacatttgattctgacaatctcctggctgtgttctgataacgacaatcncatctgtcttgatctcct

SEQ ID NO: 732 - DNA, 295 bp, Zea mays
  unsure (1)..(295): unsure at all n locations
ggacgttcgacctgccgganggcgaagaagttccagtctgctgcttactccaactgcgcaaagaagccatcctgatatcccttttggcttcctcgttctagtagtttaggatttcttttctgacacttcgattcttaccaatccccctggcctgcngctttcctgataatcgaccagttccccagtcttgctccctgcagtcctccctcctccatctccagcgttgtgttctgactcacctgcaccaatggctgttctttctgctgctggtgctccccgggctnaagtatngggt

SEQ ID NO: 733 - DNA, 532 bp, Zea mays
  unsure (1)..(532): unsure at all n locations
ggnnnnnnnaactgtctattcngcccgggcccggtccacaaattnacggggtcnacgcagcgtccgcncacgncgtccgcccacgccgtccgcccacgcgtccggggcaaatgcttatgtgattggagatgcagcaagaaccagggacagaagtggcacatctactacgccactgagacccagagcaaccaatggtcaaccttgagatgtgcatgactggtctggacacgaagaaacttcagtcttcttcaagactaatgctgatggcaacacaacatgtgccaaggaaatgacgagctctctggtaanctctgaaattatccctgagatggagatctgtgattttgacttcgaaccctgcggctactcccatgaatgcaatccatgggctctgcgttctccacgattcatgtgacgcctgaggatgggttcaagctacgccaagttatgaagttatggggcntggatgccatggncctgttctaaaggngaaccttttcaaaaaggggcccttngggggcttccgcccccc

SEQ ID NO: 734 - DNA, 269 bp, Zea mays
atccccctggcctgctgctttcctgacaatcgaccagttccccagtcttgctccctgcagtcctccctcctccatctccagcgttgtgttctgactcacctgcaccaatggctgttctttctgctgctggtgctcccccggcctcagctatcgggtttgagggctatgagaagcgccttgagatcacattctctgaggcacctgtctttgtggacccccatggcagcggtttgcgtgccctctccaggtcccagattgactctgttctg

SEQ ID NO: 735 - DNA, 231 bp, Zea mays
  unsure (1)..(231): unsure at all n locations
gcttcgtcgatttgaatttgatgtactaatggagtctaagggtggcaaaaagtctagcagtagtcgttccatgatgtatgaagctccccttggctacagcattgaggacgttcgacctgccggagggtgaagaagttccagtctgctgcttactccaactgcgcgaagaagccatcctgatatcccttttggcttccgcatnnaggagttagggtttctacccnnccngng

SEQ ID NO: 736 - DNA, 220 bp, Zea mays
cgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatgaacgtatggagaaatatctgtgaacccattttgtttatgaataagatttgtttttttcgagtt

SEQ ID NO: 737 - DNA, 442 bp, Zea mays
  unsure (1)..(442): unsure at all n locations
caaagaattccctcccctagccgccgncgccgccgctcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctcccttggctacagcattgaggacgttcgacctgccggaggcntnaagaagttccagtctgctgcttactncaactgcgcgaaaaanccatcctgatatcctttggctttcctcatctaatagtttangattcttttctgacctttgat

SEQ ID NO: 738 - DNA, 527 bp, Zea mays
  unsure (1)..(527): unsure at all n locations
gnggngggtggtnanngnnntcnannaanaatctnctaccggcccggaattcccgggtcgacccacgcgtccgaaagaattccctcccctagccgccgccgccgctcgtctccctgagaggtgccgggaccgaggatttggncgagttctaggtagagaatcggttttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctncccttggctacagcattgaagacgttcgacctgccngaagcctgaaaaagttcaatctgntgcttactccaactgcgccaaagaaaccattctgatatcccttttggcttcctcattctaagtaagtttaaggattcttttctgacactttgattcttancaa

SEQ ID NO: 739 - DNA, 249 bp, Zea mays
ccttgggtgcttcggcccctcggaattttctgtcgccgtgaccatcttcggcgggcggggccaagctgggacatggggaaaggaacttggtgcggaggcttatgactgcaacaacatggtcgagcaggagctgcctggaggtgggatcctcatctaccagagcttctgtgctgctgaagacgccgttgctagctcgcccaaatccgttcttcgctgctttgatggcgagaatgcagcacttttgcgaag

SEQ ID NO: 740 - DNA, 514 bp, Zea mays
  unsure (1)..(514): unsure at all n locations
aagtgttnntntnggggggggggnnnntnaatgttgtaccggtccggaattcccgggtcgacccacgcgtccggttgccaaagaattccctcccctagccgccgccgccgctcgtctccctgagaggtgccgggaccgaggatttggccgagttctaggtagagaatcggttttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgcgaagaaccatcctgatatcccttttggcttnctcattctagtaanttaagaattcntttnttgac

SEQ ID NO: 741 - DNA, 298 bp, Zea mays
gtagtttaggatttcttttctgacacttcgattcttaccaatccccctggcctgctgctttcctgacaatcgaccagttccccagtcttgctccctgcagtcctccctcctccatctccagcgttgtgttctgactcacctgcaccaatggctgttctttctgctgctggtgctcccccggcctcagctatcgggtttgagggctatgagaagcgccttgagatcacattctctgaggcacctgtctttgtggaccccatggcagcggtttgcgtgccctctccaggtcccagattga

SEQ ID NO: 742 - DNA, 217 bp, Zea mays
tttttttttaactcgaaaaaaacaaatcttattcataaacaaaatgggttcacagatatttctccatacgttcatgctcattgtggtagacgcagctgaccacctagagctgcatacttacttattcagactgatccagcatgtggcaacatcggaagttcacatgcttacagacgacaaattttcataacaatagcctggcttggctgcttcacag

SEQ ID NO: 743 - DNA, 181 bp, Zea mays
tgcgattttgacttcgaaccctgtggctactccatgaatgcgatccatggctctgcattctccacaatccatgtgacgcccgaggacggtttcagctacgccagttacgaggttatgggcttggatgccactgctctgtcttatggtgaccttgtcaagagggtcctccggtgctttggcc

SEQ ID NO: 744 - DNA, 373 bp, Zea mays
  unsure (1)..(373): unsure at all n locations
gccaaagaattccctcccctagccgccgnnnccgctcgtctccctgagaggtgccgggaccgaggatttggccgagttctaggtagagaatcggttttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaagttccagtctgctgcttactccaactgcgc

SEQ ID NO: 745 - DNA, 281 bp, Zea mays
  unsure (1)..(281): unsure at all n locations
gtctcagcccggggtctgctgcgtctggtggtggtgaaggggagaaattcgtnaganctgttccggatcaggcgtgcgaggctcnggaattcaggggtttcacacatagcttcgtcgatntgaatttnatgtactaatggagtctaagggtngcaaaaagtctagcagtagtcgttctatgatgtatgaagctccccttggctacagcattgaggacgttcgacctgccggaggngtgaagaagttccagtctgctgcttactccaactgcgcgaagangc

SEQ ID NO: 746 - DNA, 184 bp, Zea mays
gtggcaaaaagtctagcagtagtcgttctatgatgtatgaagctccccttggctacagcattgaggacgttcgacctgccggagggtgaagaagttccagtctgctgcttactccaactgcgcgaagaagccatcctgatatcccttttggcttcctcattctagtagtttaggatttcttttc

SEQ ID NO: 747 - DNA, 170 bp, Zea mays
cagcaagacctggacagaagtggcacgtcttctacgccactgagtacccagagcaaccaatggttaaccttgagatgtgcatgactggtctggacaagaagaaagcttgtgtctttttcaagactaatgctgatgggaacacaacatgtgccaaggaaatgacaaagctc

SEQ ID NO: 748 - DNA, 441 bp, Zea mays
  unsure (1)..(441): unsure at all n locations
attacntnccctagccggcgtcgccgctcgtnttcctgagaggtgccgggaccganggnntggncganttctangtagagaatcggttttactngtctcaacccggngtctgctgcgtctggtggtggtgaangggagaaattcntgagatctgtnccggatcaggcgngcgagctcgggaatcaggggtttcacacatagcttcgtccgatttgaatttgatgtactanatggantctaanggtggcaaaaagtctancattagtcgctctatgatgtatgaanctcccctnggctacagcattgaggacgttcgacctgccggaggcgtgnanangttccagtctgatgcttactncaactgcgcganganccatcctgatatcccttttggntncctcattctagnacgttagganttnttgttgacacttngattct

SEQ ID NO: 749 - DNA, 195 bp, Zea mays
  unsure (1)..(195): unsure at all n locations
agcaagacctggacagaagtggcacgtcttctacgccactgagtacccagagcaaccaatggttaaccttgagatgtgcatgactggtctggacaagaagaaagcttctgtctttttcaagactaangctgatgggnacacagcatgtgcnaaggaatgacaaagctctctggcatctctgagtcatccccgagt

SEQ ID NO: 750 - DNA, 463 bp, Zea mays
  unsure (1)..(463): unsure at all n locations
gactagttctagatcgctagccgcacgcttcttgttgccaaagaattccctcccctagccgccgccgccgctcgtctccctgagaggtgccgggaccgaggatttggccgagttctaggtagagaatcggttttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagcattgaggacgttcgacctgccggaggcgtgaagaaattccagtctgctgcttactcnactgngcgaagaaccatnctgatatccttttnggtttcttaatctaagannttangattctt

SEQ ID NO: 751 - DNA, 292 bp, Zea mays
  unsure (1)..(292): unsure at all n locations
gtgttctgattcacctgctccaatggctgtnctttctgctgctgatgcttccccggtctcagctatcgggtttgagggctatgagaagcgctttgagatcacattctctgaggcacctgtcttgtggacctcatgggcgtggtttgcgtgnccctctncnagggcccagattgaactctgtacnggatcttggcaggnngcaaaattgtgtctggagctctccaacaaggatttcgactcatatgtcctntctgaagtnaagcttgtntatcnnnnccaggaagatngacca

SEQ ID NO: 752 - DNA, 291 bp, Zea mays
  unsure (1)..(291): unsure at all n locations
ggagaagtttaagatctgttccacagatcacgcgtgcncgctcgcgaatcgggggttccacacataatntnactanttgaatttgatgtactaatggantctaanggtggcaagaagtncagcagtagtcgntccatgatgtatgaagctccccttggctacagcatnngaanncgttcgacctgccggagnncgaagaagttccagtctgctgcttactccaactgcgcaaagaagccatcctgatatcccttttggcttcctcgttctagtagtttaggatttcttttc

SEQ ID NO: 753 - DNA, 506 bp, Zea mays
  unsure (1)..(506): unsure at all n locations
gtggggnngnaatgttcgttgccgtgccggtccgaaaatcacgggtcgacccacgcgtccgaagaattccctcatagccgccgccgccgccgccgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacagcattgaggacgttcgacctgccggaggcgccaagaagttccaatctgctgcttactccaactggcgcaaagaaancatcctgaaaacccctttggnntcctccttccaataatttaaggattcctttccnaaaacnt

SEQ ID NO: 754 - DNA, 275 bp, Zea mays
  unsure (1)..(275): unsure at all n locations
ggatgtatgaagctccccttgggctacagcattgaggacgttcgaacctgnccggancgttgaagaagttccagtctggctgnttacgnccaactgcgccnaagangccatcctggatatcccttttggcttcctcattctagnagtttaggatttcttttctgacactttgatgctgacnaatctctctggcctggtgcttcctgataatcgaccagttcccagtcttgctccttgcatcctcgctcctccatctncagcattgtgtccgattc

SEQ ID NO: 755 - DNA, 158 bp, Zea mays
tcgtttggttattctgtgaagcagccaagccaggctattgttatgaaaatttgtcgtctgtaagcatgtgaacttccgatgttgccacatgctggatcagtctgaataagtaagtatgcagctctaggtggtcagctgcgtctaccacaatgagcatg

SEQ ID NO: 756 - DNA, 165 bp, Zea mays
  unsure (1)..(165): unsure at all n locations
cctccctccatctccagcattgtgttctgattcacctgctccaatggctgttctttctgctgctgatgcttccccggtctcagctatcgggtttgagggctatgagaagcgccttgagatcacattctctgaggcacctgtctttgtngaccctcattcncntng

SEQ ID NO: 757 - DNA, 157 bp, Zea mays
agcgccttgagatcacattctctgaggcacctgtctttgtggaccctcatgggcgtggtttgcgtgccctctccagggcccagattgactctgttctggatcttgcacggtgcacaattgtgtccgagctctccaacaaggatttcgactcatatgt

SEQ ID NO: 758 - DNA, 221 bp, Zea mays
  unsure (1)..(221): unsure at all n locations
tgatgtcgcatgcacgcgtacgtaagctcggaattcggctcgagngaaatgacaaagctctctggcactctgaaatcatccccgagatggagatctgcgattttgacttcgaaccctgtggctactccatgaatgcgatccatggntctgcattctccacaanccatgtgacgcccgaggacggtttnagctangcnagttangaggttntgggctgggnn

SEQ ID NO: 759 - DNA, 493 bp, Zea mays
  unsure (1)..(493): unsure at all n locations
gggnnnnnnggnaacttntaccgngccgtaccggtcaanaaattcccgggtcnacccaccgtccgnacacgcgtccgctcccctagccgccgccgccgccgctcgtctccctgagagggccgggaccgaggaactggccgagtactaggtagagaatcggtttttcttgtctcagccggggtctgctgcgtctggtggtggtgaaggggagaaattcgtgagatctgttccggatcggcgtgcgagctcgggaatcaggggtttcacacatagcttcgtcgatttgaatttgatgactaatggagtctaagggtggcaaaaagtctagcagtagtcgttctaatgatgtatgaactccccttggctacagcattgangacgttcgacctgccggaggcgtnaagaanttccagcctgctgctactccaactgcgcnaaagaanccatcctganaacccctttgggctcctcatccaataanttaaggatttct

SEQ ID NO: 760 - DNA, 218 bp, Zea mays
  unsure (1)..(218): unsure at all n locations
cngacntgtgtgccgggatcaggcgtgcnagctcgggaatcaggggtttcacacatagctccttcgatttgaatttgatgtactaatggngtctaagggtggcaaaaagtctagcagtagtcgttctatgatgtatgaagctccccttgggctacagcattgaggangttcgacctgccggacgtgaagaagttccagtctgntgnttactccaaatg

SEQ ID NO: 761 - DNA, 168 bp, Zea mays
  unsure (1)..(168): unsure at all n locations
gcaagaccnggacagangtggcacgtcttctacgccacngagtacccagagcaaccaanggtnaaccttgagangtgcatgacnggtctggacaagaagaaagcntgtgtctntnncaagactaatgcngatgggaacacaacangtgccaaggaaatgacaaagcnc

SEQ ID NO: 762 - DNA, 151 bp, Zea mays
  unsure (1)..(151): unsure at all n locations
ggagagtgctcctcctcctatgaagaaggactacaagctggctaatcttctctgctggnaggaggaagcggatgccatggaggagaaggcgggagtgcttgatgagtaagacgggcttctggggtcgatttgcttctgagttgtttatttt

SEQ ID NO: 763 - DNA, 228 bp, Zea mays
  unsure (1)..(228): unsure at all n locations
cttgtcaagagggtcctccngtgctttggcccctcagagttttccgttgccgtgaccatcttcggcgggcgtggccatgccgggacatggggaaaggcacttggtgcagaggtctatgactgcaacaacaatggtggaataggancttcctggaaggcggggntcctcgtgtaaccaaaaacttctgtgctgctnaagacncngttgctaacctcgccccaaattttt

SEQ ID NO: 764 - DNA, 147 bp, Zea mays
agcttgatgagtaagacgggcttctggtgtcgatttgcttctgagttgtttattttatatcgtcgcaatttcgtggttgtcgtttggttattctgtgaagcagccaagccaggctattgttatgaaaatttgtcgtctgtaagcatg

SEQ ID NO: 765 - DNA, 187 bp, Zea mays
cgtgaccatcttcggccgggcgtggccatgccgggcacatggggaaaggcactaggtgcagaggtctatgactgcaacaacatgtggagcaggagctgcctggaggcgggctcctcgtataccagagcttctgcgctgctgaagacgctgttgctaccttcgcccaaatctgttttccactgctttg

SEQ ID NO: 766 - DNA, 154 bp, Zea mays
gcttcctgataatcgaccagttccccagtcttgctccttgcactcctccctcctccatctccagcattgtgttctgattcacctgctccaatggctgttctttctgctgctgatgcttccccggtctcagctatcgggtttgagggcatgagaa

SEQ ID NO: 767 - DNA, 162 bp, Zea mays
  unsure (1)..(162): unsure at all n locations
tctggatcttgcacggtgcacaattgtgtccgagctctccaacaaggatttcgactcatatgtacctctctgagtcaagcttgtttatctatccctctgaagattgtnatcaagacctgtggcactaccaagctcctgctcaccattccaagaatccttgag

SEQ ID NO: 768 - DNA, 320 bp, Zea mays
ccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgccgg

SEQ ID NO: 769 - DNA, 295 bp, Zea mays
  unsure (1)..(295): unsure at all n locations
ctcgtctccctgagangtgccgggaccgaggaactggccgagttctaggtagagaatcggttttgcttgtctcagcannnggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgacctgcc

SEQ ID NO: 770 - DNA, 329 bp, Zea mays
  unsure (1)..(329): unsure at all n locations
ccatcttcggcgggcgtggccatgncggggacatggggaaaggacttggtgnagaggtctatgactgcaacaacatggtggagcagagctgcctggagcgggctctctgtaccagagttcngtgctgctgaagacgtgtgntactcgccaatctgttnccactgcttgacggcgagacgtggaagtgtcctcctcctatgaagaaggatacaagctggctaatcttctctgtgggaggaggagcggatncatggaggagaaggcgggatgcttgattgagtagacgggttctggggtcgattnttctgagtgttattntncgcgcaatt

SEQ ID NO: 771 - DNA, 511 bp, Zea mays
  unsure (1)..(511): unsure at all n locations
agnaggtggtttaattagnngaagggnggnaaatgaaagactntccggctngaattcccgggtcgacccacgcgtccgattnantcccatagccgacnacggcgntcgtctgcctgagaggtgccgggaccgaggnactggncgagttctagggagagaatcggttttgcttgtctnagcacggggtctgntgcgtctggtggtggtgaaggggagaaattcgtgagatctgttccggatcaggcgtgcgagctcgggaatcaggggtttcacacatagnttcgtngatttgaatttgatgtactaatggagtctaagggtggcaaaaagtctagcanggagtcgttccatgatgtatgaagctccccttggntacaggattgaagacgttagactncctganggcatgaaaaaagttcaagctggnggttnnttcaancnccncnanaaaccgttcntnaattccctttnggttncttaatctnaaannttaaganttnctttcttaaaa

SEQ ID NO: 772 - DNA, 154 bp, Zea mays
taagcatgtgaacttccgacgttgccacatgctggatcagtctgaataagtaagtatgcagctctaggtggtcagctgcgtctaccacaatgagcatgtacgtatggagaaatatctgtgaacccattttgtttatgaataagatttgtttttt

SEQ ID NO: 773 - DNA, 160 bp, Zea mays
taagcatgtgaacttccgatgttgccacatgctggatcagtctgaataagtaagtatgcagctctaggtggtcagctgcgtctaccacaatgagcatgacgtatggagaaatatctgtgaacccattttgtttatgaataagatttgtttttttcgagtt

SEQ ID NO: 774 - DNA, 126 bp, Zea mays
  unsure (1)..(126): unsure at all n locations
cctccctccatctccagcattgtgttctgattcacctgctccaatggctgttctttctgctgctgatgcttccccggtctcagctatcgggtttgngggctatgngaagcgccttgagatcacatt

SEQ ID NO: 775 - DNA, 391 bp, Zea mays
  unsure (1)..(391): unsure at all n locations
aatctctacngctccagggcccggnccaggaantacggngtcgacccatccacacaggcanccggttgccaaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacagcattgaggacgttcgac

SEQ ID NO: 776 - DNA, 493 bp, Zea mays
  unsure (1)..(493): unsure at all n locations
gtgagngtttntttngnnnanggnggngngatgntatcttcgtccggaattcccgggtcgacccacgcntccgctnccctagccgccnccgcccgntcgtctccctgagaggtgccnggaccgangaactggccgngttctaggtagagaatnggttttgcttgtctcancacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtantcnttccatgatgtatgaagctncccntggctacagcattgaggacgtcnanctncccggaagcnttaaanaattncagnctgtgnttantnnaactgncnaanaaacnattctganatnnctttttggntttnntantnnaananttnanganttntttt

SEQ ID NO: 777 - DNA, 193 bp, Zea mays
  unsure (1)..(193): unsure at all n locations
taagcatgtgaacttccgatgttgccacatgctggatcagtctgaataagtaagtaatgcagctncngggttggtcagntgcgtctagcanaatgagcatgtacgtatggagaaatntnntgtgaacccattttgtttatgaataagatttgttttttttcgagttaaaanaaaaaaaaaagggcggccncng

SEQ ID NO: 778 - DNA, 136 bp, Zea mays
  unsure (1)..(136): unsure at all n locations
gtgacgcccgaggacggtttcagctatgccagttatgaggttatgggcttggatgccactgctctntccttatggtgaccttgtcaagagggtccttcggtgctttggcccctcggagttttccgttgccgtganc

SEQ ID NO: 779 - DNA, 117 bp, Zea mays
ggctgttctttctgctgctgatgcttccccggtctcagctatcgggtttgagggctatgagaagcgccttgagatcacattctctgaggcacctgtctttgtggaccctcatgggcg

SEQ ID NO: 780 - DNA, 253 bp, Zea mays
  unsure (1)..(253): unsure at all n locations
tcccctagcngccgccgccgccgatcgtctcccctgagaggtgccgggaccgangaacttggccgagtactaggtagagaaattcgtgagatctgttccngatcangcgtgcgagctcgggaatcaggggtttcacacatagctcgtcgatntgaatttgatgtactaatggagtctaagggtggcaaaaagtctagcagtagtcgttctatgatgtatgaagctccccttggctacagcattgatgacgttc

SEQ ID NO: 781 - DNA, 273 bp, Zea mays
tcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacagc

SEQ ID NO: 782 - DNA, 110 bp, Zea mays
gtggagagtgctcctcctcctatgaagaaggactacaagctggctaatcttctctgctgggaggaggaagcggatgccatggaggagaaggcgggagtgcttgatgagta

SEQ ID NO: 783 - DNA, 272 bp, Zea mays
tcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttggctacag

SEQ ID NO: 784 - DNA, 491 bp, Zea mays
  unsure (1)..(491): unsure at all n locations
gagttnttcntgnnggggggnagganngnaaaacttntaccggtccggaattcccgggcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctaacaagtagtcgttccatgatgtatgaagctccccttggctacagcatttgaaggacgttcgaacctgccggaagcnttnaagaagttncaagtctgctgnttacttccaacttgngccaaaaaagccatcctgatattccntttggctttcctaatctaagtaagtttaaggattcctttcttg

SEQ ID NO: 785 - DNA, 273 bp, Zea mays
  unsure (1)..(273): unsure at all n locations
tcatctcgccgagangtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaanggtggcaagaagtctagcagtagtcgttccatgatgtatgaagctccccttggctacagcattga

SEQ ID NO: 786 - DNA, 310 bp, Zea mays
  unsure (1)..(310): unsure at all n locations
gttgccaaagaattccctcccctagccgccgccgccgctcgtctccctgagaggtgccgggaccgaggaactggccgagttctaggtagagaatcggttttgcttgtctcagcacggggtctgctgcgtctggnggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacag

SEQ ID NO: 787 - DNA, 307 bp, Zea mays
gccaaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttccatgatgtatgaagctccccttggctacag

SEQ ID NO: 788 - DNA, 107 bp, Zea mays
gctgaagagctgtctatgccacttgctgctgtgaagtactcccgtgggacgttcatctttcctggtgcacagccagccccccacaggagcttctctgaggaagttgc

SEQ ID NO: 789 - DNA, 265 bp, Zea mays
tcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctccccttg

SEQ ID NO: 790 - DNA, 304 bp, Zea mays
  unsure (1)..(304): unsure at all n locations
cncctanccgccgccgccgctcgtctccctgagaggtgccgggaccgaggaactggccgagttctaggtagagaatcggttttgcttganntcagcacggggtctgctgcgtctggtggtggtgaaagggagaaattcgtgagatctgttccggatcaggcgtgcgagctcgggaatcaggggtttcacacatagcttcgtcgatttgaatttgatgtactaatggagtctaaagggtggcaaaaagtctagcagtagtcgttccatgatgtatgnagctcccctttgctacaacattgnggac

SEQ ID NO: 791 - DNA, 149 bp, Zea mays
gcttgtttatctatcctctgaagattgtcatcaagacctgtggcactaccaagctcctgctcaccattaccaagaatccttgagcttgctgaagagctgtctatgccacttgcaccaggaaagatgaacgtccctagttctagatcgcg

SEQ ID NO: 792 - DNA, 273 bp, Zea mays
tcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttggctacacattgag

SEQ ID NO: 793 - DNA, 285 bp, Zea mays
  unsure (1)..(285): unsure at all n locations
ctagccgncgccgccgangctcgtctccctnagaggtgccgggancgaggaactgggcgagtactaggtagagaatcngtttttcttgtctcagcccggggtctgctgcgtctggtggtnntgaaggngagaanttcgtgagatctgttccggatcaggcgtgcnagctcgggantcaggggtttcacacatagcttcgtcgatttgaatttgatgtactaatngagtctaanggtggcaaaaagtctagcagtagtcgttctatgangtatgaagctccccttg

SEQ ID NO: 794 - DNA, 135 bp, Zea mays
  unsure (1)..(135): unsure at all n locations
aaggaaatgacaaagctctctggcatctctgaaatcatccccgagatggagatctgcgatttggacttcgaaccctntggctactccannantgcgntccatggctctngattntgcnacaatccntgtgacgcc

SEQ ID NO: 795 - DNA, 258 bp, Zea mays
tcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagct

SEQ ID NO: 796 - DNA, 261 bp, Zea mays
tcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctccccttgg

SEQ ID NO: 797 - DNA, 260 bp, Zea mays
tcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaagctcc

SEQ ID NO: 798 - DNA, 102 bp, Zea mays
ctttgattctgaccaatctctctggcctgctgcttcctgataatcgaccagttccccagtcttgctccttgcactcctccctcctccatctccagcattgtg

SEQ ID NO: 799 - DNA, 254 bp, Zea mays
tcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatga

SEQ ID NO: 800 - DNA, 255 bp, Zea mays
  unsure (1)..(255): unsure at all n locations
tcgtctccctgagaggtgccgggaccgaggaactggccgagtactaggtagagaatcggtttttcttgtctcagcccggggtctgctgcgtctggtggtggtgaaggggagaaatncgtgagatctgttctggatcaggcgtgcgagctcgggaatcaggggtttcacacatagcttcgtcgatttgaatttgatgtactaatggagtctaagggtggcaaaaagtctagcagtagtcgttctatgatgtatgaa

SEQ ID NO: 801 - DNA, 255 bp, Zea mays
tcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgtatgaa

SEQ ID NO: 802 - DNA, 255 bp, Zea mays; identical to SEQ ID NO: 801

SEQ ID NO: 803 - DNA, 299 bp, Zea mays
gttgccaaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagctccgtcgatttgaatttgatgtactaatggagtctaagggtggcaaaaagtctagcagtagtcgttccatgatgtatgaagctccc

SEQ ID NO: 804 - DNA, 295 bp, Zea mays
  unsure (1)..(295): unsure at all n locations
tcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtgcaaaaagtctagcagtagtcgtntatgatgtataaagcnccccttggctanagcattgaggacgttngacctgccggg

SEQ ID NO: 805 - DNA, 255 bp, Zea mays
tcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatgaagctcc

SEQ ID NO: 806 - DNA, 278 bp, Zea mays
  unsure (1)..(278): unsure at all n locations
cctncgccgccgccgctcgtctccntgagaggtgccgggaccgaggaactggccgagtactaggnagagaatcggtttttcttgtctcagcccggggtctgctgcgtctggtggtggtgaaggggagaaattcgngagatctgttccggatcaggcgtgcnanctcggnaatcaggggtttcacacatagcttcgncganttgantntnatgtactaatggagtctaagggtggcaaaaagtctagcagtagncgttctatgatgtatgaagctcccc

SEQ ID NO: 807 - DNA, 127 bp, Zea mays
  unsure (1)..(127): unsure at all n locations
ttccggatcaggcgtgcgagctcgggaatcaggggtttcacacanagcttcgtcgatttgaatttgatgtactantggagtctaagggtggcaaaaagtctagcagtagtcgttctatgatgtntga

SEQ ID NO: 808 - DNA, 251 bp, Zea mays
tcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgta

SEQ ID NO: 809 - DNA, 250 bp, Zea mays
tcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttctatgatgt

SEQ ID NO: 810 - DNA, 250 bp, Zea mays; identical to SEQ ID NO: 809

SEQ ID NO: 811 - DNA, 260 bp, Zea mays
tcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgcttcgcgaatcgggggttccacacatagcttcgtcgttttgaattgatgtactaatggagtctaagggtggcaagaagtctagcagtagtcgttccatgatgtatgaagctccccttg

SEQ ID NO: 812 - DNA, 257 bp, Zea mays
  unsure (1)..(257): unsure at all n locations
cgccgccgctcatctcgccgagaggtgacgggaccgaggaactcgccgagttctaagatagagaatcgcttttcacagcctggggtctgctgcgtanggtggtgttgaaggggagaagtttaagatctgttccacagatcacgcgtgcgcgctcgcgaatcgggggttccacacatagcttcgtcgttttgaatttgatgtactaatggagtctaagggtggcaagaagtctagcagtagtcgttccatgatgtatg

SEQ ID NO: 813 - DNA, 155 bp, Zea mays
  unsure (1)..(155): unsure at all n locations
tcgattcttaccaatccccctggcctgctgctttcctgacaatcgaccagttccccagtcttgtccctgcagtcctccctctccatctccagcgttgtgttctgactcacctgcaccaatggctgttctttctgctgctggtgtcccccggntca

SEQ ID NO: 814 - DNA, 276 bp, Zea mays
  unsure (1)..(276): unsure at all n locations
anaattccctcccctagccgccgccgccgctcgtctccctgagaggtgccgggaccgaggaactggccgagttctaggnaganaatcggttttgcttgtctcagcacggggtctgctgcgtctggtggtggtgaaggggagaaattcgtgagatctgttccggatcaggcgtgcnagctcgggaatcaggggtttcacacatagcttcgtcgatttgaatttgatgtactaatggagtctaagggtggcaaaaagtctagcagtagtcgttccatg

SEQ ID NO: 815 - DNA, 97 bp, Zea mays
  unsure (1)..(97): unsure at all n locations
gnagattgtcatcaagacctgtggcactaccanagctcctgctcaccattccaagaatccttgagcttgcngaaganctgtctatgccanttggctg

SEQ ID NO: 816 - DNA, 262 bp, Zea mays
ccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttcc

SEQ ID NO: 817 - DNA, 281 bp, Zea mays
  unsure (1)..(281): unsure at all n locations
gttgccaaanaattccntcccctagccgccgccgccgctcgtctccctgagaggtgccgggaccgaggaactggccgagttctaggtagagaatcggttttgcttgtctcancacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcgttcc

SEQ ID NO: 818 - DNA, 250 bp, Zea mays
tcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaattgatgtactaatggagtctaagggtggcaagaagtctagcagtagtcgttccatgatgtatgaag

SEQ ID NO: 819 - DNA, 253 bp, Zea mays
ttcgtctccctgagaggtgccgggaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcatagtcgttctatgatgtatg

SEQ ID NO: 820 - DNA, 247 bp, Zea mays
  unsure (1)..(247): unsure at all n locations
tcgtctccctgagaggtgccgagaccgaggaactggccgagtactaggtagagaatcggtttttcttgtctcagcccggggtctgctgcgtctggtggtggtgaaggggagaaattcgtgagatctgttccggatcaggcgtgcgagctcgggaatcaggngtttcacacatagcttcgtcgatttgaattgatgtactaatggagtctaagggtggcaaaaagtctagcagtagtcgttctatgat

SEQ ID NO: 821 - DNA, 279 bp, Zea mays
  unsure (1)..(279): unsure at all n locations
attccctcccctagccgccgccgccgctcgtctccctgagaggtgccgggaccgaggaactggccgagttctaggtagagaatcggttttgcttgtctcagcacgggtctgctgcgtctggtggtggtgaaggggagaaattcgtgaagatctgttccggntcaaggcgtgcgatctcgggaatcaggggtttcacacatagcttcgtcgatttgaatttgatgtactaatggagtctaagggtggcaaaaagtctagccagtagtcgttccatgatgt

SEQ ID NO: 822 - DNA, 253 bp, Zea mays
  unsure (1)..(253): unsure at all n locations
tcgtctccctgagaggtgccgggaccgaggaactggccgagtactangtanagaatcnncttttcttgtctcagcccggggtctgctgcgtctggtggtngtgaaggggagaaattcgtgagatctgttccggatcaggcgtgcgagctcgggaatcaggggtttcacacatagcttcgtcgatttgaatttgatgtactaatggagtctaagggtngnnaaaagtctagcagtagtcgtctatgatgtatna

SEQ ID NO: 823 - DNA, 269 bp, Zea mays
caaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtag

SEQ ID NO: 824 - DNA, 296 bp, Zea mays
  unsure (1)..(296): unsure at all n locations
cttcttgttgccaaagaattccctcccctagccgccgccgccgcttcgtctccctgagaggtgccgggaccgangaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagtagtcttccatgatgtat

SEQ ID NO: 825 - DNA, 296 bp, Zea mays
  unsure (1)..(296): unsure at all n locations
gncaaagaattccctcccctagccgccgccgccgctcgtntccctgagaggtgccgggaccgaggaactggccgagttctaggtagagaatcggtnttgcttgtctcagcacggggtctgctgcgtctggtggtggtgaaggggaganattcgtgagatctgttccggatcaggcgtgcgagcncgggaatcaggggtttcacacatagctcgtcgatttgaatttgatgtactaatggagtctaagggtggcaaaaagtctagcatagtcgttccatgatgtatgaagctcccct

SEQ ID NO: 826 - DNA, 267 bp, Zea mays
aaaagaattccctcccctagccgccgccgccgctcgtctccctgagaggtgccgggaccgaggaactggccgagttctaggtagagaatcggttttgcttgtctcagcacggggtctgctggtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtctagcagta

SEQ ID NO: 827 - DNA, 506 bp, Zea mays
  unsure (1)..(506): unsure at all n locations
gagcggnnnntnnntatgttggggggnntaatnnttctactggtccggaattcccgggtcgacccacgcgtccggttgccaaagaattccctcccctagccgccgccgccgctcgtctccctgagaggtgccgggaccgaggatttggccgagttctaggtagagaatcggttttacttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggaatctaanggtggcaaaaantctaacaataatcgntctatgaatggatgaaactncccttggctncancattgaagaccttcganctnnccgaagcnttaaaaaattccagtctgntggttacttcaactnngccgaaaaaccattctggaattccctttngntttcctnaatctaatanttaaggatt

SEQ ID NO: 828 - DNA, 295 bp, Zea mays
ctcggaattcggctcgagaaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaatctagcagtagtcgttccatg

SEQ ID NO: 829 - DNA, 265 bp, Zea mays
gttgccaaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtc

SEQ ID NO: 830 - DNA, 271 bp, Zea mays
cttcttgttgccaaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtc

SEQ ID NO: 831 - DNA, 228 bp, Zea mays
tcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaatttgatgtactaatggagtctaagggtggcaagaagtctagcag

SEQ ID NO: 832 - DNA, 227 bp, Zea mays
tcgtctccctgagaggtgccgggaccgaggaatggccgagtactaggtagagaatcggtttttcttgtctcagcccggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaagtct

SEQ ID NO: 833 - DNA, 270 bp, Zea mays
  unsure (1)..(270): unsure at all n locations
gttgccaaaganttccctcccctagccgccgccgccgctcgtactccctgagaggtgccgggaccgaggaactggccgagttctaggtngagnatcggttttgcttgtctcagcacggggtctgctgcgtctggtggtggtganggggagaaattcgtgagatctgttccggatcaggcgtgcgagctcgggaatcaggggtttcacacatagcttcgtcgatttgaatttgatgtactaatggagtctaanggtggcaaaaagtctanc

SEQ ID NO: 834 - DNA, 222 bp, Zea mays
  unsure (1)..(222): unsure at all n locations
tcgtctccctgagaggtgccgggaccgaggaactggccgagtactaggtagagaatcggtttttcttgtctcagcccggngtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaa

SEQ ID NO: 835 - DNA, 261 bp, Zea mays
  unsure (1)..(261): unsure at all n locations
aaagaattccctcccctagccgccgcngccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttgatgtactaatggagtctaagggtggcaaaaatctac

SEQ ID NO: 836 - DNA, 97 bp, Zea mays
  unsure (1)..(97): unsure at all n locations
tcagctgcgtctaccacaatgagcatgaacgtatggngacatatctgtgaacccattttgtttatgaataagatttgtttttntcgagtnaaaaaaa

SEQ ID NO: 837 - DNA, 229 bp, Zea mays
gtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagctcgtcgatttgaatttgatgtactaatggagtctaagggtggcaaaaagtctagca

SEQ ID NO: 838 - DNA, 254 bp, Zea mays
  unsure (1)..(254): unsure at all n locations
ganttccctcccctagccgccgccgccgctacgtctccctgagaggtgccgggancgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaatttnatgtactaatggagtctaagggtggcaaana

SEQ ID NO: 839 - DNA, 493 bp, Zea mays
  unsure (1)..(493): unsure at all n locations
caaagaattccctcccctagccgccgncgncgctcgtctccctgaagaaggtgcccgggaccgagggatttggcccgagttctaggtaagaagaaatcgggttttacttgtctcaagcccgggggtctgcttgcgtctggtggtgggtgaaaggggaagaaattcgtgaagatctgttccggatcaggcgtgcgaanctcgggaatcagggggtttcacacataagcttcgtcgatttgaatttgatgtactaaatgggaagtctaaagggtggcaaaaagtctagcagtaagtccgttctatgatgtatgaaacttccctttggctacagcatttgaaggacgttcgacctggccggangccttgaagaangttccagtctgnttgnttacttcaacttgngccaaaaaaccattctggatattccttttgggntttcctcaatctagtannttaanganttcttttctgacacttttgaatcttganccaa

SEQ ID NO: 840 - DNA, 296 bp, Zea mays
  unsure (1)..(296): unsure at all n locations
angnacgcgtacgtnagctcgnaattcngctcgagcggctcgagcnaagaattccntcccctagccgccgccgncgccgctcgtctccctgagaggtgccggnaccgaggaactggccgagtactaggtagagaatcgntttttcttgtctcagcccggggtctgctgcgtctggtggtggtgaangggagnaattcgtnagatctgttccggatcaggcgtgcgagctcgggaatcaggggtttcacacatagcttcgtcgatttgaatttgatgtactaatggagtctaagggt

SEQ ID NO: 841 - DNA, 292 bp, Zea mays
  unsure (1)..(292): unsure at all n locations
tngccnnananttccnncccctagccgccnccgccgccgctngtntccctgagaggtanccgggaccgatgaactngccgagtactaggtagagaatcggtttntcttntctcagcccggggtctgctncntctggtggtggtgaaggggagaaattcgtganatctgttccggancatgcgtgngagctcnggaatcaggggtttcacacatagcttcgtcgatttgaatntgatgtataatggatctaagggtngcaanaantctagcagtagtcgtncnagntgnatga

SEQ ID NO: 842 - DNA, 254 bp, Zea mays
cgccgccgctcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctcgcgaatcgggggttccacacatagcttcgtcgttttgaattgatgtactaatggagtctaaaggtggcaagaagtctagcatatcgttccatgatgtatg

SEQ ID NO: 843 - DNA, 255 bp, Zea mays
gccaaagaattccctcccctagccgccgccgccgctcgtctccctgagaggtgccgggaccgaggaactggccgagttctaggtagagaatcggttttgcttgtctcagcacggggtctgctgcgtctggtggtggtgaaggggagaaattcgtgagatctgttccggatcaggcgtgcgagctcgggaatcaggggtttcacacatagcttcgtcgatttgaattgatgtactaatggagtctaagggtggcaa

SEQ ID NO: 844 - DNA, 214 bp, Zea mays
  unsure (1)..(214): unsure at all n locations
tcatctcgccgagaggtgacgggaccgaggaactcgccgagttctaagatagagaatcgcttttcacagcctggggtctgctgcgtagggtggtgttgaaggggagaagtttaagatctgttccacagatcacgcgtgcgcgctncgcgaatcgggggttccacacatagcttcgtcgtttgaatttgatgtactaatggagtctaagggtggc

SEQ ID NO: 845 - DNA, 798 bp, Zea mays
  unsure (1)..(798): unsure at all n locations
gccacgcgtgcgncaaaacaacaatgnntntnntttggagggcttttgaaaaagccccttgggggatcaacattcttcttgagggcnccctggtcttttgtgggacccctcatgggcgtgggttttgncgtgcccctcttccaaggccccagattgactctgttctgggatctttgcacgggngcacaaattgtgtcccgagctcttccaacaagggatttccgactcatatgtcctttctgaggcaaagcttgnttatctatcctctgaagattgtcatcaaagacctgtggcactaccaagctcctgctcaccattccaaagaatccttgaacttgcttgaaaaacttgtctatgccactttgctgcttgtgaaaatactcccgtgggacggtcatcttttctgggngcacagncaggccccccacaaggaacttcttttgaaggaagttgntgnactttaaaccgcttcttttggccggcctggaaatctgggggggnaatgcnttntgtggaattggggaatnccancnaggaacctggacaanaaatnggnaccgntttttaacnccccttgattnccccnagcaacccaatgggtnaaccttnaaaagggccntgactgggctgggcnnnnnnnnnnnnnnnnnnnnnnnnnaanaataatgttgangggaacacaacttgggccaagggaaatganaaactttttgnnttttgaaaatatnccccgaanggaaaacgngantttantttaacccggggttttcaggaaggggcccagggtttgttttcnaa

SEQ ID NO: 846 - DNA, 268 bp, Zea mays
  unsure (1)..(268): unsure at all n locations
tcgtctccctgagaggtgccgggaccgaggaactggccgagtactaggtagagaatcggtttttcttgtctcagcccngggtctgctgcgtctggtggtggtgaangggagaaattcgtgaganctgtaccactcaggcgtgcgagctcgggaatcaggggtttcacacatagcttcgtcgatttgaatttgatgtacnatggagtctaagggtggcaaaaatctagncntatcgttctangattatnaagccccctnggtaaannat

SEQ ID NO: 847 - DNA, 276 bp, Zea mays
  unsure (1)..(276): unsure at all n locations
gcngccgccgccnctcgtctccctgagaggtgccgggaccgaggaactggccgagtactaggtagagaatcggtttttcttgtctcagcccggggtctgctgcgtctggtggtggtgaaggggagaaattcgtgagatctgttccggatcangcgtgcgagctcgggaatcaggggtttcacacatagctcgtcgatttgaatttgatgtacnaatggatcnaagggtggcaaaaagtctagcagnagtcgtctatgatgtatgaagctccccttg

SEQ ID NO: 848 - DNA, 185 bp, Zea mays
gcaagctacctgtgacaaaaacgattccaagaaaccacttcttgtgcttcctccactggctgtctgtgcatcttgctctaaaacaatcgcagtcctgcaagttgttgctgttgctcctacccctgcctctgcaattgggtttgagggatatgagaagcgcctcgagatcagcttctatgaggcac

SEQ ID NO: 849 - DNA, 519 bp, Zea mays
  unsure (1)..(519): unsure at all n locations
gnaagggatctttnaaggnggggggggggaaaanganaactncgtaccggtccggaattcccgggtcgacccacgcgtccgagagcttcgactcatatgttctgtccgagtccagcctctttgtgtatccgggacagggttgttctgaagacctgtgggacgacgaagctgctgctcgccattcctcgcatccttgagcttgctgcagggctgtcactgcctcttctttcagcgaagtactctcgtgggaccttcatcttccccggcgcgcagcccgcgccacaccgcagcttctcggaggaggtatctgtgctgaacgctttctttggtaacctcaagtccggtggcaatgcctacctgatcggtgaaccgttcaagcccaacaagaagtggcatgtctactacgccacagaggagcctgagcgtcctatggtgacgcttgagatgtgcatgacagagcttgacgttaagaaagctgctgtgttcttcaagaacttcactggtggcaacttnacntna

SEQ ID NO: 850 - DNA, 324 bp, Zea mays
atgagaagcgcctcgagatcacgttctctgactcgcctgtctttgaggacccttgtggtcgtggcctgcgcgccctctcccgtgagcagatcgactcgtttctggatctcgcacggtgcaccatagtgtcacagctctccaacgagagcttcgactcatatgttctgtccgagtccagcctctttgtgtatccccacaaggttgttctgaagacctgtgggacgacgaagctgctgctcgccattcctcgcatccttgagcttgctgcagggctgtcactgcctcttctttcagcgaagtactctcgtgggaccttcatcttcc

SEQ ID NO: 851 - DNA, 260 bp, Zea mays
gaagcgcctcgagatcacgttctctgacgcgcctgtctttgaggacccttgtggtcgtggcctgcgcgccctctcccgtgagcagatcgactcgtttctggatctcgcacggtgcaccatagtgtcacagctctccaacgagagcttcgactcatatgttctgtccgagtccagcctctttgtgtatccccacaaggttgttctgaagacctgtgggacgacgaagctgctgctcgccattcctcgcatccttgagcttg

SEQ ID NO: 852 - DNA, 272 bp, Zea mays
agcgcctcgagatcacgttctctgacgcgcctgtctttgaggacccttgtggtcgtggcctgcgcgccctactcccgtgagcagatcgactcgtttctggatctcgcacggtgcaccatagtgtcacagctctccaacgagagcttcgactcatatgttctgtccgagtccagcctctttgtgtatcccacaaggttgttctgaagacctgtgggacgacgaagctgctgctcgccattcctcgcatccttgagcttgctgcaggctgtcat

SEQ ID NO: 853 - DNA, 239 bp, Zea mays
gcgcctcgagatcacgttctctgacgcgcctgtctttgaggacccttgtggtcgtggcctgcgcgccctctcccgtgagcagatcgactcgtttctggatctcgcacggtgcaccatagtgtcacagctctccaacgagagcttcgactcatatgttctgtccgagtccagcctctttgtgtatccccacaaggttgttctgaagacctgtgggacgacgaagctgctgctcgccattc

SEQ ID NO: 854 - DNA, 267 bp, Zea mays
  unsure (1)..(267): unsure at all n locations
cctgcgcgcnctntcncgtgagcagatcgagtcgtttctggatctcgcacggtgcaccatagtgtctcagctctnccaangagagctncgactcatatgttctgtncgagtccagcctctttgtgtatccccacaaggntgttctgaagacctgtggnacgacgaagctgctgctcgcnattcctcgcatccttgagcttgctgcagggctgtcantgcctcttctttcagcgaagtactctcgtgggaccttcatcttccccggcg

SEQ ID NO: 855 - DNA, 295 bp, Zea mays
  unsure (1)..(295): unsure at all n locations
attggctttgagggctatgagangcgcctcgagatcacgttctctgacgcgcctgtctttgaggacccttgtggtcgtggcctgcgcgccctctcccgtgagcagatcgactcgtttctggatctcgcacggtgcaccatagtgtcacagctctccaacgagagcttcgactcatatgttcagtccgagtccagcctcttgtgtatccccacaaggttgttncgaagactgtgggacgacgaagctgctgctcgccattcctcgcatcntgagntgctgcaggctgtcatgcctc

SEQ ID NO: 856 - DNA, 266 bp, Zea mays
  unsure (1)..(266): unsure at all n locations
caccatagtgtcacanctctccaacgagagcttcgactcatatgttctgtccgaatccagcctctttgtgtatccccacaaggttgttctcaagacctgtgggacnacgaagctgctgctcgccattcctcgcatccttgagcttgctgcagggctgtcactgcctcttctttcagcgaagtactctcntgggaccttcatcttccccggcgcgcagccgcgccacaccgcagcttctcggaggaggtatctgtgctgaacgcttt

SEQ ID NO: 857 - DNA, 316 bp, Zea mays
  unsure (1)..(316): unsure at all n locations
cagcctctttgtgtatccccacaaggttgttctgaagacctgtgggacgacgaagctgctgctcgccattcctcgcatccttgagcttgctgcagggctgtcactgcctcttctttcagcgaagtactctcgtgggaccttcatcttccccggcgcgcanccgcgccacaccgcagcttctcggaggaggtatctgtgctgaacgctttctttggtaacctcaagtccggtggcaatgcctacctgatcggtgaaccgttcaagcccaacaagaagtggcatgtctactacgccacagaggagcctgagcgtccta

SEQ ID NO: 858 - DNA, 219 bp, Zea mays
ggtatcttaaacttagaactcttcagcgtgcatcatatactcattacttctatgaagcaactgttggtgctggcctccctatcattagcactctgcgtggtctcctagagacaggtgacaagatattgcgcattgaagggattttcagtggaacgttaagttatatttttaacaacttcgaaggagcaagaacctttagtgatgttgttgctgaagcaa

SEQ ID NO: 859 - DNA, 323 bp, Zea mays
cagcactccaggagtcagtgcaatactttttgatgcattagcaaaggcaaacattaatgttcgagcaatagctcaaggttgcagtgaatacaatattactgttgtattgaagcaacaagattgtgtaagggctctgagagctgctcactcaaggttcttcctctccaaaaccacacttgctgttgggatcattggacctggtttaattggtggagcactccttaaccagttgaagaatcagactgctgttctcaaggaaaatatgaacattgatctgcgtgtcattggaataactggctcaagtacaatgcttttgagcgaca

SEQ ID NO: 860 - DNA, 310 bp, Zea mays
  unsure (1)..(310): unsure at all n locations
ctttctgatattcctgtgaagagccttgtgccagaaacacttgcagcatgctcgtcagcagatgaattcatgcagaagctaccatcctttgacgaggactgggccaggcaacgcagtgagtgctgatgcngcagacgaagtcctgcgttacgttggagtggtggatacggtgaacaagaggggacaggtggagctacgtaggtacaagagggaccacccgttcgcgcantctccggctccgacaacatcatcgcattcaccacctcgaggtacaaggagcagccgctaatcgtgcggngcccaggcgcgg

SEQ ID NO: 861 - DNA, 242 bp, Zea mays
  unsure (1)..(242): unsure at all n locations
tgaacactctgtatgctttgctgttccagaaaaggaagttgcattggtttctgcagccttgcatgctaggtttcgtgaagcattggcagcagggaggttatctaaggttgaagtcattcntaattgtagcatccttgctactgtcggcctgaggatggcaagtacacctggagtcagcgcgaccctttttgatgcactagctaaggcaaatnttaatgtaagggcgatantcaaggttgcag

SEQ ID NO: 862 - DNA, 303 bp, Zea mays
tgaaaaacgacttgaaaaatggttttctcgatgtccggctgagacaataattgctactgggtttattgcgagtacacctgaaaacatcccaacaaccttaaaaagagatggaagtgatttctctgcagccataattggttcccttgttaaggctcgccaggtgaccatctggactgatgttgatggggtatttagtgcagatcccagaaaagttagtgaggctgtaatcttaagcacattgtcgtatcaggaggcctgggaaatgtcatattttggggcaaatgtcttgcatccacgtactat

SEQ ID NO: 863 - DNA, 294 bp, Zea mays
gtgaagtcagcatatctttgacactggatccatcgaaactatggagttgtgaattggttcagcacaaaaatgaacttgatgatgtcattgaagagcttgagaagatagcagttgttcatctactgcagaacaggtcaataatatctttaatttgaaatgtgcagaggtcgtctttgattcttgaaaaggctttcaatgttctacgaagaaacggtgtcaatgtccagatgatatcgcaaggggcgtccaaggtgaacatttccttggtggtccatgacagtgaggcaaaacagt

SEQ ID NO: 864 - DNA, 224 bp, Zea mays
  unsure (1)..(224): unsure at all n locations
gttgctaccagtgaagttagtgtttctgtgtcacttgatccatcaaagatctggagtagggaactgatacagcaggaacttgaccatgtagttgaagagcttgagaaaatagcaattgttcgtctacttcagcagagggcgataatttcacttatcggaaatgtggagcaatcgtcnctcatactagaaaagacgggacgtgtgctgaggaaaagtggggttat

SEQ ID NO: 865 - DNA, 240 bp, Zea mays
  unsure (1)..(240): unsure at all n locations
tggagtggtggatgtggtcagcaagaaggggcaggtggagctgcgagcctacaagagggncccacccgttcgcgcactatctggttccgacaacatcatagccttcaccacctcgaggtacaaggatcagccactgatcgtgcgaggtccgggggctggtgcggaagtgactgcaggaggcgtcttctgcgacatactgcgcctgtcttcctaccttggtgccccctcgtagtctgtcaa

SEQ ID NO: 866 - DNA, 243 bp, Zea mays
  unsure (1)..(243): unsure at all n locations
cttgggattaagagaaattcaggtttggaaagatgttgatggtgttttaacatgtgacccaaatatccatcctaaggcaaaacctgtgccatacttgacatttgatgaggcagctgaacttgcctattttggagcgcaggttttgcatccacaatcaatgcggccagctagagaaggcgatgtacctgtgagggttaagaatcttataaccgtcgngcccctggtacccttatcataaagcng

SEQ ID NO: 867 - DNA, 286 bp, Zea mays
  unsure (1)..(286): unsure at all n locations
gaaggtcataattcttgcaagggaatctggtttggggcttgaactttctgatattcctgtacgaagtcttgtgccggangcttnaagtcatgtacctcagccgacgaatacatgcagaagttaccatcttttgacgaggattgggcaagagagaggaaaaatgctgaagctgcgggagaagttctgcggtatgttggagtggtgnatgtggtcncaaaaagggccnaggtgaantnngccctnaaaggggggccccccntttggnnaaaantggtcncaaaaaaaa

SEQ ID NO: 868 - DNA, 275 bp, Zea mays
  unsure (1)..(275): unsure at all n locations
aagagaagctacaaactgaagcagaacctgccaatcttgataagtttgttcatcatttgtctgagantcacttttttcctaacagagttttggtagattgcacagcagatacaagtgttgcatctcactattatgattggctaaagaaaggaatccatgtcatcactccaaacaagaaagcaaattcagggccacttgacaggtatcttaaacttagaactcttcagcgtgcatcatatactcattacttctatgaagcaactgttggtgctggc

SEQ ID NO: 869 - DNA, 241 bp, Zea mays
  unsure (1)..(241): unsure at all n locations
ctttagtgatgttgttgctgaagcaaaaaaagcaggatacacagaaccagatccaagagatgatctgtctggtactgatgttgccaggaaggtcataattcttgcaagggaatctggtttggggctgagctttctgatattcctgtacgaagtcttgtgccagangcacttaagtcatgtacctcagccgatgaatacatgcagaagttaccatcttttgacgaggattgggcaagagaga

SEQ ID NO: 870 - DNA, 292 bp, Zea mays
  unsure (1)..(292): unsure at all n locations
atggattaatgatcctgctatacctatagtcactggctttcttggcaagggatggagatctggtgcaataactanttgggcaggggtggtagcgacttgacagctacaaccattggcaaagccttgggattaagagaaattcaggtttggaaagatgttgatggtgttttaacatgtgacccaaatatccatcctaaggcaaaacctgtgccatacttgacattgatgaggcagctgaacttgcctatttggagcgcagttttgcatccacaatcaatgcggccactagaga

SEQ ID NO: 871 - DNA, 226 bp, Zea mays
  unsure (1)..(226): unsure at all n locations
gggaatgcccaggcggggttcaccttcgtcatgaagttcggcggctcgtcgctcgcgtcagccgagcggatgcgggangtggccggcctcatccttagcttcctcgacgagatgcctgtcgccgtcctctccgccatggggaagaccaccaataacctcntcctaggaccttccatttctagctctcagcgcctgagtcagggtgctcgattcttcgttatagtaa

SEQ ID NO: 872 - DNA, 285 bp, Zea mays
  unsure (1)..(285): unsure at all n locations
gtcattgattcttgaaaaggcattcaacgttctgcgaagaaatggtgttaatgtcnagatgatctcacaaggggcgtccaaggtgaacatatccttggtagtcaatgacagtgaggcaaaacagtgcgtacaagccctccattcagcgttctttgagaatggattcttgtcggaggtagagggagctgacgttccccagaacggagcctctctgaactcaaatggcgctgtctatggaaactagtcgactctgcaactgctttcttcacaatttgtgtaccattg

SEQ ID NO: 873 - DNA, 286 bp, Zea mays
ccaaggcgtccgaaatccctgagctcgctgtcatcaaggacctgcatcttaggacggttgatgagctcggtttagataggtcgattgtttcaggtttattggatgaattggagcaacttcttaaaggagttgctatgatgaaagagctgacccttaggacaagagattaccttgtttcctttggtgaatgtatgtcgacaagaatatttgctgcatatttgaacaaacttgggaaaaaagcacgccatatgatgcattgatatggcttataaccaccgatgatttc

SEQ ID NO: 874 - DNA, 293 bp, Zea mays
  unsure (1)..(293): unsure at all n locations
ttcacaaatgcggatattcttgaagccacttaccctgctgttgcgaagaggctacatgaagactggatggatgaccctgctattcctatagtcactggttttcttgggaagggatgtaaatcatgtgctgtcaccactttaaggcaggggtggtagtgacttgacagctacaaccattggcaaagccttggggattaagagaaatccaggttggaaggatgtagatggtgtgtgacatgtgatcctnatatatatggcaaatgctatancccgtgcctacttgactttggatg

SEQ ID NO: 875 - DNA, 266 bp, Zea mays
actgccaagtcccttggctatacagaaccagatccacgtgatgatctaggtggaatggatgtcgctagaaaggcattgatcctggctaggcttcttgggcaacagataagcatggagagtatcaatgttgaggtttatatcctagtgaattaggacctgatgcagtgtccacaaaggacttcctgaaagtggtttagtgcaattgacaagagcatggaagaaagaatcagagcagcatctcgagaggaaacgttctcgctacgtct

SEQ ID NO: 876 - DNA, 343 bp, Zea mays
  unsure (1)..(343): unsure at all n locations
ggctggttctaggacaaatgcttttaagtgatataggagtagatttgacccagtggaaagagaagctacaaactgaagcagaacctgccaatcttgataagtttgttcatcatttgtctgagaatcactttttccctaacagagttttggtagattgcacagcagatacaagtgttgcatctcactattatgattggctaaagaaaggatccatgtcatcactccaaacaagaagcaantcagggccattgacaggttcttaancttgactcttcaggggcataattatcatacttctangagnantgtggnnngccccananatnnccnngggtnnnannag

SEQ ID NO: 877 - DNA, 442 bp, Zea mays
  unsure (1)..(442): unsure at all n locations
gngatctngngnantanctancttgngnanntgngnggtncacttnacnncnannnncattggcnanncnttgagattaaganatactcntgttaggnaagatgctgatggtgntggaacatgtgaccgagatatacatcctaaagctgaacctganccatacttgacatctngatgaatcagctgaacnngcctattttggagcgcaggaattgcatgcactatnnatgcggtcagngttgagaaggcgatntacctgtgagggctaatgaattnttataactcgnctagnctanggtacccttatcactaaaacntgnacgatatgagttaagantgttcagactngcattgtncttgaaaatgaatattnaatgcttgatatattcagtacagggtatgctttgccaagtaccggatnaataanncccntttaagggaa

SEQ ID NO: 878 - DNA, 285 bp, Zea mays
  unsure (1)..(285): unsure at all n locations
gnncaagacntgtgccatacttgacatttgatgaggcagctgaacttgcctatnttggagcgcaggttttgcatccacaatcaatgcggccagctagagaaggcgatgtacctgtgagggttaagaattcttataaccgtcgancccctggtacccttatcactaaagcaagagatatgagtaagactgttttgactagcattgttttgaaatcaaatattacaatgcttgatatagtcagcacacgcatgcttggccagtacggttttctagctaaggtttttt

SEQ ID NO: 879 - DNA, 282 bp, Zea mays
  unsure (1)..(282): unsure at all n locations
gncaaaacctgtgccatacttgacatttgatgaggcagctgaacttggcctattttggagcgcaggttttgcatccacaatcaatgcggccagctagagaaggcgatgtacctgtgagggttaagaattcttataaccgtcgagcccctggtacccttatcactaaagcaagagatatgagtaagactgttttgactagcattgttttgaaatcaaatattacaagcttgatatagtcagcacacgcatgcttggccagtacggttttctagctaaggtttt

SEQ ID NO: 880 - DNA, 317 bp, Zea mays
gaaccagctgatattgatagttttgttcatcatttatccgataatcacgtatttccaaacaaagttttggtggactgcacagcagatacaagtgttgcatcccactattataattggttaaagaagggtattcatgtcatcacaccaaataagaaagcaaattctgggccacttgatcagtacctgaaattgcggactctgcaacgtgcctcgtacactcattacttttatgaagcaactgttggtgctggcctcccaatcattagtaccttgcgaggtcttctggagacgggtgacaagatactgcgtattgaggg

SEQ ID NO: 881 - DNA, 315 bp, Zea mays
ggatcaggttgctgctctcaaggaaaatatgaacattgatctgcgtgtcattggaataactggctcaagtacaatgcttttgagcagacacgggaatagacttaacccagtggaaacaacttctaaaaaaggaagcagaaccagctgatattgatagttttgttcatcatttatccgataatcacgtatttccaaacaaagttttggtggactgcacagcagatacaagtgttgcatcccactattataattggttaaagaagggtattcatgtcatcacaccaaataagaaagcaaattctgggccacttgatc

SEQ ID NO: 882 - DNA, 288 bp, Zea mays
aaccagctgatattgatagttttgttcatcatttatccgataatcacgtatttccaaacaaagttttggtggactgcacagcagatacaagtgttgcatcccactattataattggttaaagaagggtattcatgtcatcacaccaaataagaaagcaaattctgggccacttgatcagtacctgaaattgcggactctgcaacgtgcctcgtacactcattacttttatgaagcaactgttggtgctggcctcccaatcatagtaccttgcgaggtcttctggagac

SEQ ID NO: 883 - DNA, 292 bp, Zea mays
ccaaaacgacacttgcagttggcatcattggacctggtttaattggtagaacactccttaaccagctcaaggatcaggttgctgctctcaaggaaaatatgaacattgatctgcgtgtcattggaataactggctcaagtacaatgcttttgagcgacacgggaatagacttaacccagtggaaacaacttctaaaaaaggaagcagaaccagctgatattgatagttttgttcatcattatccgataatcacgtatttccaaacaaagttttggtggactgcacagcagat

SEQ ID NO: 884 - DNA, 285 bp, Zea mays
cactgggttaagtctattcccgtggaaacaacttctaaaaaaggaagcagaaccagctgatattgatagttttgttcatccatttatccgataatcacgtatttccaaacaaagttttggtggactgcacagcagatacaagtgttgcatcccactattataattggttaaagaagggtattcatgtcatcacaccaaataagaaagcaaattctgggccacttgatcagtacctgaaattgcggactctgcaacgtgcctcgtacactcattacttttatgagg

SEQ ID NO: 885 - DNA, 263 bp, Zea mays
cactgggttaagtctattcccgtggaaacaacttctaaaaaaggaagcagaaccagctgatattgatagttttgttcatcatttatccgataatcacgtatttccaaacaaagttttggtggactgcacagcagatacaagtgttgcatcccactattataattggttaaagaagggtattcatgtcatcacaccaaataagaaagcaaattctgggccacttgatcagtacctgaaattgcggactctgcaacgtgcctcgt

SEQ ID NO: 886 - DNA, 279 bp, Zea mays
  unsure (1)..(279): unsure at all n locations
atttaataatttcgaaggaacaagggcattcagtgatgtcgttgctgaagcaaaagaggcgggatacacngaacctgacccaagagatgatctatctggaactgatgttgcccganaggtcattatccttgcaagggaatcaggtttgaggcttgaactttctgatattcctgtgaagagccttgtgccagaaacacttgcagcatgctcgtcagcagatgaattcatgcagaagctaccatcctttgacgaggactgggccaggcaacgcatgatgct

SEQ ID NO: 887 - DNA, 256 bp, Zea mays
  unsure (1)..(256): unsure at all n locations
tttantnntttcgaaggaacaagggcattcagtgntgtcgttgcngaagcaaaaganntgggatacactgaacctgacccaaganntgatctntctggaantgntgttgcccgaaaggtcattntccttgcaagggaatcaggnttgaggcttgaactttctggntattcctgtgaagagccttgngctngaaacacttgcagcagctcgtcagcagagagttcagcagaagctaccatcctttgacgaggactgg

SEQ ID NO: 888 - DNA, 322 bp, Zea mays
  unsure (1)..(322): unsure at all n locations
gggagactggatggatgaccctgctattcctatagtcactggttttcntggncagggatgtaaatcatgtgctgtcaccactttaggcaggggtggtagtgacttgacagctacaaccattggcaaagccttgggattaagagaaatccaggtttggaaggatgtagatggtgtgttgacatgtgatcctaatatatatgcaaatgctatacccgtgccctacttgacttttgatgaggctgctgagcttgcctactttggtgcacaggttttgcatccccaatcaatgcgaccggctagggatggtgatattccagtgaga

SEQ ID NO: 889 - DNA, 105 bp, Zea mays
  unsure (1)..(105): unsure at all n locations
gtgatcctaatatatatgcaaatgctatacccgtgccctacttgacttttgatgaggctgctgagcttgcctactttggtgcacaggttanacatcccccagtca

SEQ ID NO: 890 - DNA, 279 bp, Zea mays
  unsure (1)..(279): unsure at all n locations
gtgagtacaacattactattgtactgaagcaagaagactgcgtgcgggctctgagagctgcccactcaaggntcttcctctccaaaaccacactggctgntggcatcattggacctgggntgattggtcgcacattacttaatcagctgaaggatcaggctgctgtcctcaaggaaaatatgaacattgatttgcgtgtcatgggaatagctggttctaggacaatgcttttaagtgatataggagtagatttgacccagtggaaagagaagctacnaa

SEQ ID NO: 891 - DNA, 282 bp, Zea mays
gctatgcaaatattaatgtaagggcgatagctcaaggttgcagtgagtacaacattactattgtactgaagcaagaagactgcgtgcgggctctgagagctgcccactcaaggttcttcctctccaaaaccacactggctgttggcatcattggacctgggttgattggtcgcacactacttaatcagctgaaggatcaggctgctgtcctcaaggaaaatatgaacattgtttgcgtgtcatgggaatagctggttctaggacaatgcttttaagtgatat

SEQ ID NO: 892 - DNA, 282 bp, Zea mays
gttatccatgtttctgaaatcgaagagtggaatatggtcaaaagcctacatatcaagacggtggatgaacttggacttccaagatctgtaatacaagacatgctagatgaactggagcaactattgaaaggtatcgctatgatgaaagagctgacgcctaggaccagtgactaccttgtttcatttggagaatgcatgtccaccaggattttttctgcttatttgaacaaaattcgtgtcaaggcacggcagtatgacgcatttgatattggtttcatacaa

SEQ ID NO: 893 - DNA, 270 bp, Zea mays
gttatccatgtttctgaaatcgaagagtggaatatggtcaaaagcctacatatcaagacggtggatgaacttggacttccaagatctgtaatacaagacatgctagatgaactggagcaactattgaaaggtatcgctatgatgaaagagctgacgcctaggaccagtgactaccttgtttcatttggagaatgcatgtccaccaggatttttctgcttatttgaacaaaattcgtgtcaaggcacggcagtatgacgcatttgatattg

SEQ ID NO: 894 - DNA, 493 bp, Zea mays
  unsure (1)..(493): unsure at all n locations
gngnnnnnnggnaantgttnanttngcccgccagtaccgatccaagaattcccgggtcgacccacgcgtccgatcagcttgggctagatagatcaattgtttgtggtttgttggatgaacttgaacaacttcttaagggaattgctatgatgaaagagctgactcttaggacacgagattatctagtttcatttggtgaatgcatgtctacaagaatatttgctgcacttttaaacaaaattggagtaaaagctcggcagtatgatgcatttgatcttggctttataactaccgatgatttcacaaatgcggatattctggaagcaacttatcctgctgttgcaaggaggctacatgtggaatggattaatgatcctgctatacctatagtcactggctttcttggcaagggatggagatctggtgcaataactaccttgggcangggtggtaatgacttgacagctacaaccattggcaaagccttgggaat

SEQ ID NO: 895 - DNA, 281 bp, Zea mays
  unsure (1)..(281): unsure at all n locations
aaaganctgnctcttaggacacgagattatctagttgcagtnggtgaatgcatggctacaagaanattggcctgcactttnaaacaaaattggagtaaaagtctcggcagtatgatgcatgtnatcttggcttgataactaccgatgatttcacaaatgcggntattctggaagcaacttatcctgctgttgcaaggaggcgacatgtggaatggattaatgatcctgcnagacctatagtcantggcnttcttggcaagggatggagatctggtgcaata

SEQ ID NO: 896 - DNA, 299 bp, Zea mays
gcgcgggcgcggaggtgactgcgggtggcgtcttctgcgacatcctgcggctggcgtcttaccttggcgctccttcttagagcttccacttacagttgtcaatttgaagaggcagatggacagtgccctgcatgatgcctccgtgtttaggcttattatggacttgctcaaagttgttctgaataagtgccaggaaataaggcctctatcttatttaggcctctatcttcggggtagctgactaagtgttgttatgctacggaatccagaatctgtgaattgaaatgaatgtaccgatg

SEQ ID NO: 897 - DNA, 454 bp, Zea mays
  unsure (1)..(454): unsure at all n locations
actttacttggccngccaggtcaagatncccgggtcgacccacgcntccaccgcttcngccctcncgctttcgttgtcatgaggagcctcaccgtggcaagccgccacccgggcgccgctttctctacccgccgccgcccccttcttcaccccgccgcagccggaagggactcgaccttccagcggtgctggcgatgggaaaaaactcaggacagctccttcgggagctcactaaggaccagccgccttccaagaactgtgcacggagatattttgaagaatttgctcgcaccaactgctggtgctgtttcagttgagcaagctgaagctattgctgacctcccaaaaggtgaaatgtggtcggtgcacaagtttggtggcacatgcatggggacctctgagagaattcacaatgttgctgataaaanccctnnggattccttcgaanaaggaa

SEQ ID NO: 898 - DNA, 310 bp, Zea mays
  unsure (1)..(310): unsure at all n locations
ccgccctctcgctttcgttgtcatgaggagcctcaccgtggcaagccgccacccnggcgccgctttctctacccgccgccgcccccttcttcaccccgccgcagccggaaaggactcgaccttccagcggtgctggcgatgggaaaaaactcaggacagctccttcgggaantcactaaggaccanccgccttccaagaantgtgnacggagatattttgaagnatttgctcgcaccaactgctggtgctgtttcagttgagcaagctgaagctattgctgacctcccaaaaggtgacatgtggtcggtg

SEQ ID NO: 899 - DNA, 276 bp, Zea mays
  unsure (1)..(276): unsure at all n locations
tatgatgtgacaggnacttgatcatgtcgttgaagagcttaaaaaatttgcagttgttcatctgctgcaacgtagatcgatcatctcactgatagggaatgtacagcgatcgtcattgattcttgaaaaggcattcaacgttctgcgaagaaatggtgttaatgtccagatgatctcacaaggggcgtccaaggtgaacatatccttggtagtcaatgacagtgaggcaaaacagtgcgtacaagccctccattcagcgttctttgagaatggatc

SEQ ID NO: 900 - DNA, 240 bp, Zea mays
tgaattgatccagcaggaacttgatcatgtcgttgaagagcttaaaaaatttgcagttgttcatctgctgcaacgtagatcgatcatctcactgatagggaatgtacagcgatcgtcattgattcttgaaaaggcattcaacgttctgcgaagaaatggtgttaatgtccagatgatctcacaaggggcgtccaaggtgaacatatccttggtagtcaatgacagtgaggcaaaacagtg

SEQ ID NO: 901 - DNA, 279 bp, Zea mays
  unsure (1)..(279): unsure at all n locations
ggagcgtcacccggaagtatgggcccgcggccgtcgccagcggcgccgtagttgtcgacaacagctccgcgttccggatggngcccgangtgccgctcgtcatccccgaggtcaaccccgaggccatggcgaacgtccgcctcgggcagggggcgattgtggcaaatccgaattgctcgaccatcatctgcntcatggctgccacgccgctccatcgccacgctaaggtgttaaggatggttgtcagcacataccaagcagcaatggtgcgggtgctgc

SEQ ID NO: 902 - DNA, 254 bp, Zea mays
  unsure (1)..(254): unsure at all n locations
cagtgggtaggattcgtcaggacttgtccctggatgataaccgagggttggacatatttgtgtgtggtgatcagatacgtaaaggtgccgcactcaatgccgttcagattgctgaaatgctgctgaagtgaatgcgacttaaccctcttgtccctccctccctccctgtccctaattgctctgatcaaatgctggactgtactctgattagtttgtcctcnattttggtcgcctgttctgtattctgcggtgct

SEQ ID NO: 903 - DNA, 496 bp, Zea mays
  unsure (1)..(496): unsure at all n locations
ggtnnnnnaactcnccccgcnccggtacggtncaaaattcccggnncgacccacgcgtcacaagatgttgtgtacacggattggatagatcgtccacaacctcgattggaccgtcataaggaaatgggtttacagtgacgctgggaagagtgagggaatgttccgtgatggacataagttggtattgtttggacataacacagtggtaggagctgcgggtggttcgattattantgaaagttgagtgtcgccaaagggtttattgcacaaaaaggaaaacaaagtgtatatgcggagtatctcgtcactagtgtgtgtcactagacagaatagtgtgtttgtgttgtttgtgtcgtgttttccaatgaangacattgaccactagaactatgtgaaaaaaaaaannagtcaacacaaagantannaaaaaaggncggccgctctagaggatncaagcttacgtacccgtcatnacgtcanaacccttcnaaaatgt

SEQ ID NO: 904 - DNA, 435 bp, Zea mays
  unsure (1)..(435): unsure at all n locations
gtaactgcgacttgcatacgggttcctgtgatgcgcgcacatgctgaaagtgtnaagntacagtttgaaaagccacttgatgagcgcgtatgctcctcaagtaggccttaatgagaactcaaagagagagttctgggaaggcctggaggacatggttagtagtgtgccagttggcgagaagctcttcataggaggagatctcaatggccatgatactgcaagagaaattttgagagcagctcctggtgttaccattattgatgaccgagcttccaatcgctttcctacacctctggaggtatcagacaaagatgacgtancantgggtaggattcgtcaggacttgtcctggatggtaaccganggtttggacatatttgtgtgttggtgatcagatacgtaaangcgccggactnaatgccgtcaaaattggtt

SEQ ID NO: 905 - DNA, 287 bp, Zea mays
atcaccagagtgaattagcagaagaattggctgaaaggaagcatctcttctgtgcacgcccacaaacattgggagagaccatccgggcaatggacctagagacactggttcctatgagccaggggatgccaaaccagtcgtcaccctgatcaacagatttcttggcttccagttgattgacgaatctattcggttgttctcaatccatgtggattagatggtattgcgtcggtttaattccatagcaagtcaaaatacatcctaaacccactcaatccactccaatc

SEQ ID NO: 906 - DNA, 307 bp, Zea mays
  unsure (1)..(307): unsure at all n locations
ccgcgaccgatcgagcgaanancccttcccgcgccgacgccgaaaccctagctcctcttacgccatggccaccgtgtcgctcactccgcaggcggtcttctccaccgagtccggcggcgccctgggcttctgccaccatcctccgcttcccgccaaacttcgtacgccagctcagcaccaaggcacgacgcaactgcagcaacatcggcgtcgcgcagatcgtcgccgccgcgtggtccgactgcctcgctgctcgccgcctccgcggcggcggatgtcagcgcaattcctaacgctaaggttgcgg

SEQ ID NO: 907 - DNA, 265 bp, Zea mays
  unsure (1)..(265): unsure at all n locations
aaagtacattgctggacacaacgatgttattggaggatgcgtcagtggcagagtgantggtttccaaagtccntatttatcaccatgtggttggtggtgtctaaccccgaatgctncgtactancctncnncngaaacctncatctccgtgtgcatgctgaataaacntgcttncggatggccantttttagaggaacatctaaagatgccgngctactatcctggctgctagccaaccctgaacatccattgcccagagncaat

SEQ ID NO: 908 - DNA, 267 bp, Zea mays
  unsure (1)..(267): unsure at all n locations
attttcagtaaatttggtatcgaacacacactgaacatccctgcaacttttgttgttaagangttgtttgtttaggactataatctgtctagattatataatccaacaaataatgtgttatttgctggattatataatctggacagattatattctcaaacaaacacccgctaattcttccaggggacaatcggagcgtggaaacgatgccaaccaggacatactttacaaccagaacgtccaaagtgtagtgccgtaccattcgag

SEQ ID NO: 909 - DNA, 96 bp, Zea mays
  unsure (1)..(96): unsure at all n locations
tacaaatccatttctcagatgcattgatattgaacatgtatccaaatatgtgccataggcaaggganngtngccttngaatngccngnanttcncg

SEQ ID NO: 910 - DNA, 352 bp, Zea mays
  unsure (1)..(352): unsure at all n locations
accaaatcatgcatggtactgaaatgagatgcaattccaattctattgtttggatgtcactgaattgtacgttctaattccacgcaataccgaggnnctgangctttgtattgggagaggatgttctagttatagtctaattctagggaattaggcctctgatnccaaatctcaattccacgagcaancaaacaacagaatttagaaaaactgattctaattcccaattctgtgctccaatatctatatccaaccggggtgttagtattatgtagtttcactggctcttctagttgtgctttatganatctttgngacctgaagataaatttgagttttcaggaaggnactt

SEQ ID NO: 911 - DNA, 503 bp, Zea mays
  unsure (1)..(503): unsure at all n locations
gnnnnnnnnnggnngaangtccagccggncntaccggtcccanaaattcccggntcnaccacgcgtccggagatcttcatcaggggaaattcgcatggtatgggagactacggcccgttacctttgaaccctcgtaggaagtcttgagaacccttgcatgcattcgctgttgtatgctgccatgctgttgaatttagctgtactacaccagatagtgatacccgaactcacggagttaatggaaccggatagaaagctgcccatgtagtttggtgtttgttgcttacgttgtggatttactgtagtgacttgtctaatgctccgtttctccgtttggttatcgaccatattggaggcatggaattaaaataagttcaataccaaatcaaatatagtattgaaatgagatgtaattcaattctattgtttggatgtcgctgatttggaattaaaaaanaannannnaannnnnnnnnnnnnnnnnnnnnnnnnnnnnnnnnnna

SEQ ID NO: 912 - DNA, 497 bp, Zea mays
  unsure (1)..(497): unsure at all n locations
ggtttttaangggggggaggaagggaaagctttcccggtccggattcccgggtcgacccacgcgtcccgagttaaaacatcattttggnggtgggnaaatatggaacctatttcangttanttggcctngnttggatttgancccgtgnggtggagtaatctaatactccgcttgggatgtcgatattggagaggatggaattgaattggggttgaataccaaatcaggcatgatattgaaatgagatataatttcaattctattgtttggatgtcactgaattggagtttggaattatgcggtctaattctaggcaataccgagggggtgaggctttgtattggaagagggggtttctagttatagtctaatttcagggaattgggcctctgattccaaatctcaattccacatgcaacgaatcaacataatttangaaagctgattccaattctcaattctgtgattcaatctctacatccaaacggggtataag

SEQ ID NO: 913 - DNA, 548 bp, Zea mays
  unsure (1)..(548): unsure at all n locations
gnnnngcgcagagtttgttngggngnnggggggaaggangnatntgctnntccggtccggaattcccgggtcgacccacgcgtccgcgcgagcggccccctttttttttttttttttttttttttttttactaaaacctatngnctgangntcaggctaatgacattttgtctttacaatactgtgatgcaataaaactgggcaaaccattgataccaccgtatacagtaactcaataccatccaattctatgaggattaaaaatgtattggaatggattggtatgtattttgacttgctataaatttaaaccaactnaataccatccaattcacttagattaacggtgaaacgaacaaggcctaaggggagtggtaacagtctaacatcattgtacaacagcctttccgaagcccatagacattgtgagacaagatccgtaaaccatgaatcgttcttcacttaggatgaccatnttagctggtcacgaaatggtaccgggaatcacaaatntttnaacgtcccaaangaacgatcctggangctgt

SEQ ID NO: 914 - DNA, 463 bp, Zea mays
  unsure (1)..(463): unsure at all n locations
cataaataagtcgtgttttgaagggttctnntgaataagataaaggcttagatacattnagntgtatgaacgggttntttttaggtgtatctagtgtttggagaaccgcaacatgatgtctatgttgtacatgacctaagtgcatttctctaccaccagcactcttgcccaagcatggtagaccatttgtgtttaatgttcattacatgctaataaaagatactggtgggaagggtaaggttatgttttaggcacaccaaacaagaaggagtctaangaaattaagnnaccaaggtctctagtngagtaagggggtagtctttccattaaaattgactggctaaaatttaagctcgggctcttatgngngttnggngaacctatgagaaccgacngnaaggnanttgggnaatcagtnagtanttggaacnaaacggtntggtaaagtgaaccctttttccgt

SEQ ID NO: 915 - DNA, 267 bp, Zea mays
agctgaaggatttcttcaagcagtaggtgtgaagacctgaagatcagctttatctctcttttgttcctgctagggccttctcggttattccaattccatgtggattgaagtgtattaaaatggattttgacttgttatggatttaaatcaacttaataccactcaatccacatggattattggtgaaacaaacaagccctagtcgaaattcttgttaagttggtagtttgtcagacccgaaatagagttttttgggtttcgaatgga

SEQ ID NO: 916 - DNA, 284 bp, Zea mays
  unsure (1)..(284): unsure at all n locations
attttgaggcatggcagacaactgaggtcgaaatagcgtggtagcttggatctgcacatctatatgattgagggcctggtgtttaggattataatctgcccagattatataacctatcttattttgaactaagtgttagttcaaaataagttagattatataatatggacaaattatattcccaatcaaacaggctatgattggacttactgatacccattgagtagaactggatcttggacagtntncggggaaaacggatggaccttaattgaaaatttgcg

SEQ ID NO: 917 - DNA, 247 bp, Zea mays
ctgaggtcgaaatagcgtggtagcttggatctgcacatctatatgattgagggcctggtgtttaggattataacctgcccagattatataacctatcttatttgaactaagtgttagttcaaaataagttagattatataatctggacaaattatattcccaatcaaacaggctatgattggacttactgatacccatttgagtagaactgatcttgacaggtatccgagaaaacgatgaccttaat

SEQ ID NO: 918 - DNA, 254 bp, Zea mays
  unsure (1)..(254): unsure at all n locations
caactggaggtcgaaatagcgtggtagcttggatctgcacatctatatgattganggcctggtgtttaggattataatctgcccagattatataacctatcttattttgaactaagtgttagttcanaataagttagattatataatatggacaaattatattcccaatcaaacaggctatgattggacttactgatacccatttgagtagaactgatcttgacaggtatccgagaaaacgntgaccttaattg

SEQ ID NO: 919 - DNA, 508 bp, Zea mays
  unsure (1)..(508): unsure at all n locations
agangttttnnggntggggnggnnganaagtttaccggtccggattcccgggtcgacccacgcgtccgctgggaagaaggatagccacggatgctatcaccacgccggtagtgaacacgtcggcctactggttcaacaactcgcaagagctaatcgactttaaggaggggaggcatgctagcttcgagtatgggaggtatgggaacccgaccacggaggcattagagaagaagatgagcgcactggagaaagcagagtccaccgtgtttgtggcgtcagggatgtatgcagctgtggctatgctcagcgcacttgtccctgctggtgggcacattgtgaccaccacggattgctaccgcaagacaaggatttacatggaaaatgagctccctaagaggggaatttcgatgactgtcattaggcctgctgacatggatgctctccaaaatgcgttggacaacaataatgtatctcttttcttcacggagactnctacaaatccatttct

SEQ ID NO: 920 - DNA, 316 bp, Zea mays
ggagactcccacaaatccatttctcagatgcattgatattgaacatgtatcaaatatgtgccatagcaagggagcgttgctttgtatcgacagtacttttgcctcccctatcaatcagaaggcactgactttaggcgctgacctagttattcattctgcaacaaagtacattgctggacacaacgatgttattggaggatgcgtcagtggcagagatgagttggtttccaaagtccgtatttatcaccatgtggttggtggtgttctaaacccgaataacactgctcttcggatggcccagtttttagaggaacat

SEQ ID NO: 921 - DNA, 300 bp, Zea mays
ttcgatgactgtcattaggcctgctgacatggatgctctacaaaatgcgttggacaacaataatgtatctcttttcttcacggagactcccacaaatccatttctcagatgcattgatattgaacatgtatcaaatatgtgccatagcaagggagcgttgctttgtatcgacagtacttttgcctcccctatcaatcagaaggcactgactttaggcgctgacctagttattcattctgcaacaaagtacattgctggacacaacgatgttattggaggatgcgtcagtggcagagatga

SEQ ID NO: 922 - DNA, 271 bp, Zea mays
cttgttccggctggtgggcacattgtgaccaccacggattgctaccggaaaacaaggatttacatggaaactgagctccccaagaggggaatttcgatgactgtcattaggcctgctgacatggatgctctacaaaatgcgttggacaacaataatgtatctcttttcttcacggagactcccacaaatccatttctcagatgcattgatattgaacatgtatcaaatatgtgccatagcaagggagcgttgctttgtatcgacagtactt

SEQ ID NO: 923 - DNA, 266 bp, Zea mays
cacaaatccatttctcagatgcattgatattgaacatgtatcaaatatgtgccatagcaagggagcgttgctttgtatcgacagtacttttgcctcccctatcaatcagaaggcactgactttaggcgctgacctagttattcattctgcaacaaagtacattgctggacacaacgatgttattggaggatgcgtcagtggcagagatgagttggtttccaaagtccgtatttatcaccatgtggttggtggtgttctaaacccga

SEQ ID NO: 924 - DNA, 263 bp, Zea mays
tgctcagtgcacttgttccggctggtgggcacattgtgaccacacggattgctaccggaaaacaaggatttacatggaaactgagctccccaagaggggaatttcgatgactgtcattaggcctgctgacatggatgctctacaaaatgcgttggacaacaataatgtatctcttttcttcacggagactcccacaaatccatttctcagatgcattgatattgaacatgtatcaaatatgtgccatagcaagggagcgttgc

SEQ ID NO: 925 - DNA, 238 bp, Zea mays
  unsure (1)..(238): unsure at all n locations
gcgtaacctgctcggctccgacgccagcctcgccgtccacgcgggggagaggctgggaagaaggatagccacggatgctatcaccacgccggtagtgaacacgtcggnctactggttcaacaactcgcaagagctaatcgactttaaggaggggaggcatgctagcttcgagtatgggaggtatgggaacccgaccacggaggcattagagaagaagatgagcgcactggagaaagca

SEQ ID NO: 926 - DNA, 332 bp, Zea mays
  unsure (1)..(332): unsure at all n locations
gccgcaactgcagcaacatcggcgtcgcgcagatcgtcgccgccgcgtggtccgactgccccgccgcctccgcggcgcggaggtcagcgcaattcccaacgctaaggttgcgcaaaccgaccgccgtcgtcttggccgagcgtaacctgctcggctccgacgccagcctcgccgtccacgcggggganaggctgggaagaaggatcgccacggatgcgatcaccacaccggtagtgaacacgtcggcctactggttcaacaactcgcaagagctaatcgactttaaggaggggaggcatgctagcttcgagtatgggaggtatgggaacccg

SEQ ID NO: 927 - DNA, 226 bp, Zea mays
  unsure (1)..(226): unsure at all n locations
ctatgctcagtgcacttgttccggctggtgggcacattgtgaccaccacggattgctaccggaaaacaaggatttacatggaaactgagctccccaagaggggaatttcgatgactgtcattaggcctgctgacatggatgctctacaaaatgcgttggacaacaataatgtancccttttcttcacggagactcccacaaatccatttctcagatgcattgatat

SEQ ID NO: 928 - DNA, 228 bp, Zea mays
  unsure (1)..(228): unsure at all n locations
gatgactgtcattaggcctgctgacatggatgctctacaaaatgcgttggacaacaataatgtatctcttttcttcacggagactcccacaaatccatttctcagatgcattgatattgaacatgtatcaaatatgtgccatagcaagggagcgttgctttgtatcgacagtacttttgcctcccctatcaatcaganggcatgactttaggcgctgacctagttatt

SEQ ID NO: 929 - DNA, 501 bp, Zea mays
  unsure (1)..(501): unsure at all n locations
gnnagnnagaggttgatacggaacgggggnttaatggaatgctcgtaccggtccggaattcccgggtcgacccacgcgtccgggttattggaggatgcgtcagtggcagagatgagttagtttccaaagttcgnatttaccaccatgtagttggtggtgttctaaacccgaatgctgcgtaccttatccttcgaggtatgaagacactgcatctccgtgtgcaatgtcagaacgacactgctcttcggatggcccagtttttagaggagcatccaaagattgctcgtgtctactatcctggcttgccaagtcaccctgaacatcacattgccaagagtcaaatgactggctttggcggtgttgttagttttgaggttgctggagactttgatgctacgaggaaattcattgattctgttaaaataccctatcatgcgccttcttttgaagctgtgagagcataattgatcagcctgccatcatgtcctactgggattcaaa

SEQ ID NO: 930 - DNA, 489 bp, Zea mays
  unsure (1)..(489): unsure at all n locations
aacgttacgccggnccgtagccgtccaaaattcangggtcgacccacgcgtccggacaacctgatcaggttcagcattggagtggaggattttgaggaccttaagaatgatcttgttcaggccctcgagaagatataagctccaatccatttgcattaataaagttatgaggtgatggttgtctggatcttgtagagatttgtgatgatacatgagctgttgactgcgattaagttctcttgtgcttattttattctttgaattcaataagctgtggttgctgcatcttgcatgtagtgttggacttaattttacttgtcaaattacaatagtttggtcccatgtacttgtgtccgcgcctccgcggttgtgcccccaagtgtttttgtgtcatttgctgtgtaatgtgagattaagggcacgatgtccttaatcaccataataaatccaagccttaaatgtaaggattctgggttgggaatgaanaac

SEQ ID NO: 931 - DNA, 340 bp, Zea mays
tttaaaataccctatcatgcgccttcttttggaggctgtgagagcataattgatcagcctgccatcatgtcctactgggattcaaaggagcagcgggacatctacgggatcaaggacaacctgatcaggttcagcattggtgtggaggatttcgaggatcttaagaacgatctcgtgcaggccctcgagaagatctaagcactctaatcagtttgtattgacaaaatcatgaggtgatggctgtcttggatcttgtcaagatctgtgacaatgatatgagctgatgactgcgaataagttctcttttgcttatttatccgtcaaatccataagctgtgat

SEQ ID NO: 932 - DNA, 303 bp, Zea mays
ctgcatctccgtgtgcaatgtcagaacgacactgctcttcggatggcccagtttttagaggagcatccaaagattgctcgtgtctactatcctggcttgccaagtcaccctgaacatcacattgccaagagtcaaatgactggctttggcggtgttgttagttttgaggttgctggagactttgatgctacgaggaaattcattgattctgttaaaataccctatcatgcgccttcttttggaggctgtgagagcataattgatcagcctgccatcatgtcctactgggattcaaaggagcag

SEQ ID NO: 933 - DNA, 299 bp, Zea mays
tttacatttaaggcatggatttattatggtgattaaggacatcgtgccttaatctcacactacacagcaaatgacacaaaaacactaggggcacaaccgcggaggcgcggacacaagtacatgggaccaaactattgtaatttgacaagtaaaattaagtccaacactacatgcaagatgcagcaaccacagcttattgaattcaaagaataaaataagcacaagagaacttaatcgcagtcaacagctcatgtatcatcacaaatctctacaagatccagacaaccatcacctcataa

SEQ ID NO: 934 - DNA, 345 bp, Zea mays
  unsure (1)..(345): unsure at all n locations
gggaacatctaaagattgcccgtgtctactatcctggcttgcctagccaccctgaacatcacattgccaagagtcaaatgactggctttggtggtgtggttagttttgaggttgctggagactttgatgccacaaggaaattcatcgattctgttaagataccctatcatgccccttctttnggaggctgtgagagcataattgatcagcctgctatcatgtcctactgggattcaaaggagcagagggacatctatgggatcaaggacaacctgatcaggttcagcattggagtggaggttttgaggaccttaagaatgatcttgttcaggccctcgagaagat

SEQ ID NO: 935 - DNA, 274 bp, Zea mays
agtcaaatgactggctttggcggtgttgttagttttgaggttgctggagactttgatgctacgaggaaattcattgattctgttaaaataccctatcatgcgccttcttttggaggctgtgagagcataattgatcagcctgccatcatgtcctactgggattcaaaggagcagcgggacatctacgggatcaaggacaacctgatcaggttcagcattggtgtggaggatttcgaggatcttaagaacgatctcgtgcaggccctcgagaaga

SEQ ID NO: 936 - DNA, 306 bp, Zea mays
  unsure (1)..(306): unsure at all n locations
gttggtttccaaagtccgtatttatcaccatgtggttggtggtgttctaaacccgaatgctgcgtaccttatccttcgaggcatgaaaacacttcatctccgtgtgcaatgtcagaataanactgctcttcggatggcccagtttttagaggaacatctaaagattgcccgtgtctactatcctggcttgcctagccaccctgaacatcacattgccaagagtcaaatgactggctttggtggtgtggttagttttnaggttgctggagactttgatgccacaaggaaattcatcgattctgttaa

SEQ ID NO: 937 - DNA, 265 bp, Zea mays
ccaccatgtagttggtggtgttctaaacccgaatgctgcgtaccttatccttcgaggtatgaagacactgcatctccgtgtgcaatgtcagaacgacactgctcttcggatggcccagtttttagaggagcatccaaagattgctcgtgtctactatcctggcttgccaagtcaccctgaacatcacattgccaagagtcaaatgactggctttggcggtgttgttagttttgaggttgctggagactttgatgctacgaggaaa

SEQ ID NO: 938 - DNA, 322 bp, Zea mays
  unsure (1)..(322): unsure at all n locations
ctattggtggtgtggttagttttgaggttgctggagactttgatgccacaaggaaattcatcgattctgttaagatacnctatcatgccccttctttcggaggctgtgagagcataattgatcagcctgctatcatgtcctactgggattcaaaggagcagagggacatctatgggatcaaggacaacctgatcaggttcagcattggagtggaggattttgaggaccttaagaatgatcttgttcaggccctcgagaagatataagctccaatccatttgcattaataaagttatgaggtgatggttgtctggatcttgta

SEQ ID NO: 939 - DNA, 283 bp, Zea mays
cattgccaagagtcaaatgactggctttggcggtgttgttagttttgaggttgctggagactttgatgcttacgagggaaattcattgattctgttaaaataccctatcatgcgccttcttttggaggctgtgagagcataattgatcagcctgccatcatgtcctactgggattcaaaggagcagcgggacatctacgggatcaaggacaacctgatcaggttcagcatggtgtggaggattcgaggatcttaagaacgatctcgtgcaggccctcgagaag

SEQ ID NO: 940 - DNA, 282 bp, Zea mays
ctttagatgttcctctaaagattgcccgtgtctactatcctggcttgcctagccaccctgaacatcacattgccaagagtcaaatgactggctttggtggtgtggttagttttgaggttgctggagactttgatgccacaaggaaattcatcgattctgttaagataccctatcatgccccttctttcggaggctgtgagagcataattgatcagcctgctatcatgtcctactgggattcaaaggagcagagggacatctatgggatcaaggacaacctga

SEQ ID NO: 941 - DNA, 315 bp, Zea mays
  unsure (1)..(315): unsure at all n locations
gggattcaaaggagcagagggacatctatgggatcaaggacaacctgatcaggttcagcattggagtggaggattttgaggaccttaagaatgatcttgttcangccctcgagaagatataagctccaatccatttgcattaataaagttatgangtgatggttgtctggatcttgtagagatttgtgatgatacatnagctntttactgngaataagttctcttgngcttaatttantctttgnattcaataanctgtnggttgcttggaaaaaaaaaaaannntnnnnnnnnnntnnntttttnnnntnnnnt

SEQ ID NO: 942 - DNA, 261 bp, Zea mays
atttatcaccatgtggttggtggtgttctaaacccgaatgctgcgtaccttatccttcgaggcatgaaaacacttcatctccgtgtgcaatgtcagaataacactgctcttcggatggcccagtttttagaggaacatctaaagattgcccgtgtctactatcctggcttgcctagccaccctgaacatcacattgccaagagtcaaatgactggctttggtggtgtggttagttttgaggttgctggagactttgatgcc

SEQ ID NO: 943 - DNA, 277 bp, Zea mays
  unsure (1)..(277): unsure at all n locations
ttagggcgctgacctagttattcattctgcaacaaagtacattgctggncacaacgatgttattggaggatgcgtcagtggcanagatgagttggnttccnaagncgtatttatcaccatgtggttggtggtgtcctaaacccgaatgctgcgtaccttatccttcgaggcatgaaaacacttcatctccgtgtgcaatgtnagaataacactgctcttcggatggcccagtttttagaggaacatctaaagattgcccgtgtctactatcctggct

SEQ ID NO: 944 - DNA, 250 bp, Zea mays
  unsure (1)..(250): unsure at all n locations
tgcgtcagtggcagagatgagttagtttccaaagttcgtatttaccaccatgtagttggtggtgttctaaacccgaatgctgcgtaccttatccttcgaggtatgaagacactgcatctccgtgtgcaatgtcagaacgacactgctcttcggatggcccnngttttagaggagnatccaaagatttcgcgnggtcaagtatccgggcttgccaagtcaccctgaacatcacattgccaagagtcaaatg

SEQ ID NO: 945 - DNA, 303 bp, Zea mays
  unsure (1)..(303): unsure at all n locations
aggaaatcatcgattctgttaagaaaccctatcatgccccttctttcggaggctgtgagagcataattgacagcctgctatcatgtctactgggattcaaaggagcagaggggcatctatgggatcaaggacaaccttgacaggtcagcattggagtggaggattttgaggaccttaagaatgatcttgntcaggccctcgagaagatataagctccaatccatttgcattaataaaggtatgaggtgatgggtggctggatcttgagagattgngatgatncatgagctgttgctgcnatta

SEQ ID NO: 946 - DNA, 239 bp, Zea mays
ctatcatgccccttctttcggaggctgtgagagcataattgatcagcctgctatcatgtcctactgggattcaaaggagcagagggacatctatgggatcaaggacaacctgatcaggttcagcattggagtggaggattttgaggaccttaagaatgatcttgttcaggccctcgagaagatataagctccaatccatttgcattaataaagttatgaggtgatggttgctggatctt

SEQ ID NO: 947 - DNA, 248 bp, Zea mays
  unsure (1)..(248): unsure at all n locations
atttatcaccatgtggttggtggtgttctaaacccgaatgctgcgtaccttatccttcgaggcatgaaaacacttcatctccgtgtgcaatgtcagaataacactgctcttcggatggcccagtttttagaggaacatctaaagattgcccgtgtctactatccnggcttgcctagccacccngaacatcacattgccaagagtcaaatgactggctttggtggtgtggttagttttgaggttgctgg

SEQ ID NO: 948 - DNA, 223 bp, Zea mays
gatcagcctgctatcatgtcctactgggattcaaaggagcagagggacatctatgggatcaaggacaacctgatcaggttcagcattggagtggaggattttgaggaccttaagaatgatcttgttcaggccctcgagaagatataagctccaatccatttgcattaataaagttatgaggtgatggttgtctggatcttgtagagatttgtgatgatacatg

SEQ ID NO: 949 - DNA, 236 bp, Zea mays
ggagactttgatgccacaaggaaattcatcgattctgttaagataccctatcatgccccttctttcggaggctgtgagagcataattgatcagcctgctatcatgtcctactgggattcaaaggagcagagggacatctatgggatcaaggacaacctgatcaggttcagcattggagtggaggattttgaggaccttaagaatgatcttgttcaggccctcgagaagatataagc

SEQ ID NO: 950 - DNA, 181 bp, Zea mays
  unsure (1)..(181): unsure at all n locations
gctctgtggcttataaacagggattcaaaggagcagagggacatctatnggatcaaggacaacctgatcaggttcagcattggatggaggattttgaggaccttaagaatgatcttgttcaggccctcgagaagatataagctccaatccatttgcattaataaagttatgaggtgatggt

SEQ ID NO: 951 - DNA, 178 bp, Zea mays
  unsure (1)..(178): unsure at all n locations
cacaacgatgttattggaggatgcgtcagtggcagagatgagttggtttccaaagtccgtatttatcaccatgtggttggtggtgttctaaacccgaatgctgcgtaccttatccttcgaggcatgaaaacacttcatctccgtgtgcaatgtcagaataacactgctcttcggangg

SEQ ID NO: 952 - DNA, 308 bp, Zea mays
  unsure (1)..(308): unsure at all n locations
ancgaanacngctccccgcgccgccgccaaaaccctagcttctcctactccatggccactgtctcgctcaccccgcaggctgtcttctccacggagtccggtggcgccctggcctctgctaccatcctccgctttccgccaaactttgtccgccagcttagcaccaaggcacgccgcaactgcagcaacatcggcgtcgcgcagatcgtcgccgccgcgtggtccgactgcnccgcngcctccgcggcgcggaggtcagcgcaattcccaacgctaaggttgcgcaaccgtccgcngtcgtcttggcc

SEQ ID NO: 953 - DNA, 269 bp, Zea mays
  unsure (1)..(269): unsure at all n locations
gccacctccccgaaagctgccgcgaccgatcgagcgaagnncggctccccgcncccgccgccaaaaccctagcttctcctactccatggccactgtctcgctcaccccgcaggctgtcttctccacggantccggtggcgccctggcctctgctaccatcctccgctttccgccaaactttgtccgccagcttagcaccaaggcacgccgcaactgcagcaacatcggcgtcgcgcagatcgtcgccgccgcgtggtccgactgccccg

SEQ ID NO: 954 - DNA, 276 bp, Zea mays
  unsure (1)..(276): unsure at all n locations
ctgcaaaatgctgaagggtcgggtctggcaccttttgactgctggctttgcttgaggggaatcaaaaccatggctctgcgggtggagaaacaacaggctaatgcccagaagattgctgaattcctggcgtctcacccgagggtcaagcaagtaaactacgctgggcttcctgaccatcctgggcgagctttacactattcccaggcnaagggancgggctctgttctcagttttcccaccggntaaatggcccntcnaaagnaggtggggggaacc

SEQ ID NO: 955 - DNA, 440 bp, Zea mays
  unsure (1)..(440): unsure at all n locations
cgagagtagacgatcagaaccaccatatatgtcctcaccagcaagttgtgccaagaaatggaatagttgtaaaacgagtagatacaacgaaaattagtgatgtggtgtctgcaattggaccctccactagactggtttggctcgaaagtcccacgaaccctcgtcagcaaattactgacattaagacaatctcagagatagcgcattctcatggtgctcttgttttggttgacaacagcatcatgtctccagtgctctcccgtcctatagaactgggagctgatatcgtgatgcactcggctaccaaatttataacgggacatagtgatcttaagggctgggaaatcttgcagtgaaaggtganaatttgggctaaaagaaggtaagggtttctgcaaaatgcctgaaagggncgggtccgggnaccttttgactggctg

SEQ ID NO: 956 - DNA, 283 bp, Zea mays
cgtcgtggagaccaccaagtacttcagcgtaacagtcagcttcgggagcgtgaagtccctcatcagcctgccgtgcttcatgtcccacgcatcaatccctgcctcggtccgcgaggagcgtggcctaaccgacgacctcgtccggatatcggtcggcatcgaggatgtcgaggacctcatcgccgatctggaccgcgcgctcagaactggcccggtgtagacatcgccgatccttaggtcatgtcaagctatcttttgatgattcattggttgactgcttgcg

SEQ ID NO: 957 - DNA, 340 bp, Zea mays
  unsure (1)..(340): unsure at all n locations
caagtacttcagcgtaacagtcagcttcgggagcgtgaagtccctcatcagcntgccgtgcttcatgtcncacgcatcaatccctgcctcggtccgcgangagcgtggcctaaccgacgacctcgtccggatatcggtcggcatcgaggatgtcgaggacctcatcgccgatctggaccgcgcgctcagaactggcccggtgtagacatcgccgatccttaggtcatgtcaagctatcttttgatgattcattggttgactgcttgcgtgatgataataatgggaatgttgcttggatacgccgctgctanaaaaaaactgngtcnagnnacngggnnnc

SEQ ID NO: 958 - DNA, 257 bp, Zea mays
  unsure (1)..(257): unsure at all n locations
gcattctcatggtgctcttgttttggttgacaacagcatcatgtctccagtgctctcccgtcctatagaactgggagctgatatcgtgatgcactcggctaccaaatttatagcgggacatagtgatcttatggctggaattcttgcagtgaagggtgagagtttggctaaagaggtagggtttctgcaaaangctgaagggtcgggtctggcaccttttgactgctggctttgcttgaggggaatcaaaaccatgg

SEQ ID NO: 959 - DNA, 521 bp, Zea mays
  unsure (1)..(521): unsure at all n locations
ggnnnaggggctnnngtntntgacntntacttnntggcatgccgtaccggtccggaattcccgggtcgacccacgcgtccgggtgtctgcaattggaccctccactagactggtttggctcgaaagtcccacgaaccctcgtcagcaaattactgacattaagacaatctcagagatagcacattctcatggtgctcttgttttggttgacaacagcatcatgtctccagtgctctcccgtcctatagaactgggagctgatatcgtgatgcactcggctaccaaatttatagcgggacatagtgatcttatggctggaattcttgcagtgaagggtgaaaagtttggctaaagaggtanggtttctgcaaaatgctgaangggtcgggtctggcaccttttgactgntggctttgcttgaagggaatcaaaaccatggctntgcnggtggagaaacaacaggctaatgcccagaagattgctgaatttctggggtnttacccganggtcaaagcaagtaa

SEQ ID NO: 960 - DNA, 265 bp, Zea mays
atcgtgatgcactcggctaccaaatttatagcgggacatagtgatcttatggctggaattcttgcagtgaagggtgagagtttggctaaagaggtagggtttctgcaaaatgctgaagggtcgggtctggcaccttttgactgctggctttgcttgaggggaatcaaaaccatggctctgcgggtggagaaacaacaggctaatgcccagaagattgctgaattcctggcgtctcacccgagggtcaagcaagtaaactacgctg

SEQ ID NO: 961 - DNA, 148 bp, Zea mays
atatcgtgatgcactcggctaccaaatttatagcgggacatagtgatcttatggctggaattcttgcagtgaagggtgagagtttggctaaagaggtagggtttctgcaaaatgctgaagggtcgggtctggcaccttttgactgctg

SEQ ID NO: 962 - DNA, 453 bp, Zea mays
  unsure (1)..(453): unsure at all n locations
ggctgggcgctcgctgacggtgatcgcaggcgcctccggcggctccgaacgagatctgagcgcctccgcagtctccgtggaggccctggactccgtcgcctccgattctgacttagagacgaaggagcccagtgtgtcgacgatgctgacgagcttcgagaactcgttcgacaagtatggggctctgagcacaccgctgtaccagaccgccacctttaagcagccttcagctacagattatggaacttatgattacactagaagtggtaaccctactcgtgatgttctccagagcctcatggctaagcttgagaaagcagatcaagcattctgcttcaccagcgggatggcggcgttagctgcagtaacacaccttcttcangctggacaagaaatagttgctggtgangacatatatggtggttctgatcggtctacttttgcaagttgtgc

SEQ ID NO: 963 - DNA, 230 bp, Zea mays
  unsure (1)..(230): unsure at all n locations
cagcgcctccgcagtctccgtggaggccctggactccatcgcctccnattctgacttagagacgaaggagcccagtgtgtcgacgatgcnnacgagnttcgagaactcgttcgacaagtatggggctctgagcacaccggtgtaccagaccgccacctttaagcagccttcagntacagattatggaacttatgattacactagaagtggtaaccctactcgtgatgntc

SEQ ID NO: 964 - DNA, 212 bp, Zea mays
  unsure (1)..(212): unsure at all n locations
ccgtgctggacaccaacatcctctgggtgaaccccgactgcggantcaagacccgaaagtacacggaggtcaagcccgccctgaccaacatggtctccgctgctaactcattcgcacccagctngccagcgccaatgagcncttttttgctttntcgttgggaggnggcntnttanttctntttttnnaananagggcccccccttttttnt

SEQ ID NO: 965 - DNA, 275 bp, Zea mays
  unsure (1)..(275): unsure at all n locations
ggnccaaacaccaagttctcctatgcttctcacaaggctgttaacgaatataaggaggntaaggngctcngtgttganancgtgcnagtanttgttngnctagtnntgtagctgtngatctcaaagcctgccaagggtatggagaacggatncccnctggcttgcccttactaggacgatnctcccngtctacaaggaagtgnntggnnnaattnaaatgnagcnnngggttccaggattcantttnangagcccgattgtgncngcncatgaat

SEQ ID NO: 966 - DNA, 254 bp, Zea mays
  unsure (1)..(254): unsure at all n locations
caagaccctaacatctctgagcagtgtgactgcttatggttttgatcttgtccgtggttgggcttgtcacgagtgctggtttccctgctggaaagtacctctttgctggngttgtggatggacgcaacatctgggctgatgatcttgctacatcnctnagnaccncaagtcnnntgantntgnttttgggaagnaangcttgnngancaactgctgcgcgtnaggcacngcgcntgnnnctngtaaanaacaat

SEQ ID NO: 967 - DNA, 313 bp, Zea mays
  unsure (1)..(313): unsure at all n locations
cgatatggntgagtacttcggtgagcagctctccggttttgcgttcactgccaattgctgggtgcagtctatnggtcaaggtgcgtcaagcctccgatcatctacggtgacgtgagccggcccaaccccatgaccgtttctngtcgaagacggcacagagcatgacgtctcgcccaatgaaggggatgctgactggncatcacatctcactgtccttcgtcggattnacagcgaggttgngantgtacagangtcttggatcaagaaggagngaggncttgagctgtgtatccgtaccaacgcgagtnntgaa

SEQ ID NO: 968 - DNA, 313 bp, Zea mays
  unsure (1)..(313): unsure at all n locations
ggangtngagnatnttgaggctgntgcgattcaggcgatccngattgatgaggcngntctaagggagngnttggcctgcgcangttatagcatgcantctacctgcactgcgctgtccnctctatcngaatcaccnnctncagantccannacncnaaccagatccacacacatatgtgctagtnaaactntaacnanattatnttnggaatcatcgacatggacgcagatgtgatcaccatcgagaactcccgtccgacgagaagctactttccgtgttccgngagggngtgaagtacggagctgggatcng

SEQ ID NO: 969 - DNA, 222 bp, Zea mays
  unsure (1)..(222): unsure at all n locations
caaggccaaaaaagatctctgaggagggantacgtcactgncatcaaggaggaaatcaaggnaggtcgttaaggggnaagaagagcttgacattgatgtgcttgtgcatggcnagcctgagagaaacgatatggttgagtacttcggtgagcaactctcggtttttcnttnactgncaatggctnnntncaanntantngnnnaaggnncntnaagnctnna

SEQ ID NO: 970 - DNA, 534 bp, Zea mays
  unsure (1)..(534): unsure at all n locations
agntnntnnntggnnggggaaggtatgnnnnnnnnnnnnnnnnnnnnnnnnnnnnnnnnnnnnnnnnnnnnnnnnnnnnnnnnnnnnnnnnncgngctcgacaccaacatnctctgggtgaaccctgactgtggtctcaagacacgcacgtncacagaggtcaagcccgcctgaccaacatggtctctgcaccaagctcatncgcaccnaacttgncagcnngaaatgaggtcctngatagntccatggtctgatagcncggaatgagccagntgttttgaataatttgggtgntaccccctgnncnatggnggaagtgntaggttaggctctcattggngggatacgccgntacaagatgtgttttaagnnnggagtgngagnttttctttgngntatgnntctgggngtatgtttnacgctttgnttataacagaagntgaaatncgcanngttgctatacttnngccaagtnaccaaagctgaccngangaanaactgcagngcacccttacacaccaanggnggaaacgg

SEQ ID NO: 971 - DNA, 435 bp, Zea mays
  unsure (1)..(435): unsure at all n locations
ccacgcgttcgcngacgcgtgcgggaacnaccngtctaagttngagacatnctacnaantnncnattgcaatcaaaaaggaggttgaggatcttgaggctgatggtattcaggtgatccaaatcnatngggcanctgtaataggaggntctggcactacncaagttacatnatgcattctacctgnactgtnctgtccactntttnaagatcacnaactgnngatttnaagacaccacncagatncacaccnacatgtgctantcnaacttcaacnacatcatatactccattatcgacatggatgccgatntgatcacnatcgagaactcccggttntgactagaanctactgtccngantttcgtganggtatgaagtacggagctggcattgaacctggtgtctactacattcatctcctaggattcccttc

SEQ ID NO: 972 - DNA, 430 bp, Zea mays
  unsure (1)..(430): unsure at all n locations
cccactcttccnnccactcttncgngntttangacaaacttgtcatatnancttcctgggggctcattcacaccgntgnggatcttcttaacnanactaatcttgacaccgaaattaantcttgncttgcttttgctgcccagaaagctgtngaggtnnatgctcttgctaatgcattggctgntcaaaaagatnangcttacttcgcancaaatgcttctgctcatcctcgannaaannctcaccccgtgtgaccaatnaaaaantccataangctnctgntgctntcaaagctcttaccacctccgtgngaccaacattaactgctagattggatgccccatcaaaaanaatcttaaccttcccattccttccancactacaatcggntccatccacaaacccgttnaacctcatnaagatccccngt

SEQ ID NO: 973 - DNA, 266 bp, Zea mays
  unsure (1)..(266): unsure at all n locations
ttcgacttcaggcccgggatgatcagcatcaacctcgacctgnnngaagngcggcaacaanttcatcaagaccgccgcctaacggccacttcggccgtgacgacgccgacnttcacctgggaggtggtgaagcccctnaagttcgacaaggcatcggnttaaggttgggagtgtcactgtggncatgaggactancttcctctggctcttctgttacctgnaagattgctgctgntggatgagtgtgtttgatcatgactggctgc

SEQ ID NO: 974 - DNA, 303 bp, Zea mays
gttcactgccaacggatgggtgcaatcctatggatcacgctgtgtgaagccacccattatctacggtgatgtcagccggccgaaccccatgactgttttctggtccaagatggcacagagcatgacccctcgtcccatgaagggaatgttgactggtccggtcacaatcctcaactggtcattcgtcaggaacgaccagcctaggtttgagacatgctaccaaatagctcttgcaatcaaaaaggaggttgaggatcttgaggctgctggtattcaggtgatccagatcgatgaggcagctct

SEQ ID NO: 975 - DNA, 296 bp, Zea mays
  unsure (1)..(296): unsure at all n locations
caacggatgggtgcaatcctatggatcacgctgtgtgaagccacccattatctatggtgatgtcagccggccgaaccccatgactgtnttctggtccaagatggcacagagcatgacccctcgtcccatgaagggaatgttgactggtccggtcacaatcctgaactggtcattcgtcaggaacgaccagcctaggtttgagacatgctaccaaatagctcttgcaatcaaaaaggaggttgaggatcttgaggctgctggtattcaggtgatccagatcgatgaggcagctctaa

SEQ ID NO: 976 - DNA, 279 bp, Zea mays
  unsure (1)..(279): unsure at all n locations
cactgccaacggatgggtgcaatcctatggatcacgctgtgtgaagccacccattatctatggtgatgtcagccggccgaaccccatgactgttttctggtccaagatggcacagagcatgacccctcgtcccatgaagggaatgttgactggtccggtcacaatcctgaactggtcattcgtcaggaacgaccagcctaggtttgagacntgctaccaantagctcttgcantcaaaaaggaggttgaggntcttgaggctgctggtattcaggtgat

SEQ ID NO: 977 - DNA, 220 bp, Zea mays
  unsure (1)..(220): unsure at all n locations
ggaacggncgagnacgcgtgggngtncagccggccgaaccccatnactgttttctggtgcaagacggcacagagcatgaccgctcgtcccatgaagggaatgttgactggtccagtcacaatcctcaactggtcatttgtcaggaacgatcagcctaggtttgagacatgctaccaaatagctcttgcaataaaaaaggaggttgaggatcttgaggctg

SEQ ID NO: 978 - DNA, 295 bp, Zea mays
  unsure (1)..(295): unsure at all n locations
cctgaacttggcccaagcaccaagttcacatacgcttctcacaaggctgtttctgagtacaaggaggcaaaggcgctcggcattgatacagtcccagtgcttgttggaccagtgtcatacttgctcctctctaagcctgccaagggtgtggagaaatctttctctcttctttnacttcttggtagcattcttcccatctacaaggaggttgttgctgagctgaaggcagctggtgcttcatggattcaacttgatgagcctacccttgttaaagaccttgatgctcncgaattgg

SEQ ID NO: 979 - DNA, 259 bp, Zea mays
cttctcacaaggctgtttctgagtacaaggaggcaaaggcgctcggcattgatacagtcccagtgcttgttggaccagtgtcatacttgctcctctctaagcctgccaagggtgtggagaaatctttctctcttctttcacttcttggtagcattcttcccatctacaaggaggttgttgctgagctgaaggcagctggtgcttcatggattcaacttgatgagcctacccttgttaaagaccttgatgctcacgaatt

SEQ ID NO: 980 - DNA, 302 bp, Zea mays
gtttctgagtacaaggaggcaaaagcgctcggtattgatactgtcccagtgcttgttggaccagtgtcatacttgctcctctctaagcctgccaagggtgtggagaaatctttctctcttctttcgcttcttggcagcattcttcccatctacaaggaggttgtttctgaactgaaggcagctggtgcttcatggattcagtttgatgagcctacccttgttaaagaccttgatgttcacgaattgggcagcattctcttcagcatatgtgaactagagtcggcatctctggattgaatgtg

SEQ ID NO: 981 - DNA, 284 bp, Zea mays
ggcagctggtgcttcatggattcagtttgatgagcctacccttgttaaagaccttgatgttcacgaattggcagcattctcttcagcatatgctgaactagagtcggcattctctggattgaatgtgcttatcgagacatactttgctgacattcctgctgagtcctacaagaccctcacgtcattgagtggtgtgactgcttacggttttgatcttatccgtggagccaagacccttgatcttatcaggagcagttcccctctgggaagtacctcttcgctgg

SEQ ID NO: 982 - DNA, 314 bp, Zea mays
  unsure (1)..(314): unsure at all n locations
tgctgagctgaangcagctggtgcntcatggattcaacttgatgagcctanccntgttaaagaccttgatgctcacgaattggccgcattctcttcagcatatgctgaactggagtcatcgttctctggattgaatgtgcttatcgagacatacttcgctgacattcctgctgagtcctacaagaccctcacatcaatgagtgggtgtgactgcctacggnttcgatcttaaccgtngagccaagacccttgatcttatcaggagcagcttcccctctgggaagtacctcttcgtggtgttgtagatggacgca

SEQ ID NO: 983 - DNA, 231 bp, Zea mays
atacaaactaccactttattgtccctgaacttggcccaagcaccaagttcacatacgcttctcacaaggctgtttctgagtacaaggaggcaaaggcgctcggcattgatacagtcccagtgcttgttggaccagtgtcatacttgctcctctctaagcctgccaagggtgtggagaaatctttctctcttctttcacttcttggtagcattcttcccatctacaaggagg

SEQ ID NO: 984 - DNA, 229 bp, Zea mays
  unsure (1)..(229): unsure at all n locations
gtttcngagtacaaggaggcaaaggcgctcggcattganacagtcccagtgncttgtnggaccagtgtcatacttgctcctctctaagcctgccaagggtgtggagaaatctttcncncttctttcacntcttggtagcatncntcccatctacaaggaggttgtngcngagcngaaggcagcnggtgcttcatggattcaacttgatgagcctacccttgttaaagac

SEQ ID NO: 985 - DNA, 300 bp, Zea mays
atctttctctcttctttcacttcttggtagcattcttcccatctacaaggaggttgttgctgagctgaaggcagctggtgcttcatggattcaacttgatgagcctacccttgttaaagaccttgatgctcacggaattggccgcattctcttcagcatatgctgaactggagtcatcgttctctggattgaatgtgcttatcgagacatacttcgctgacattcctgctgagtccctacaagaccctcacatcattgagtggtgtgactgcttacggtttcgatcttatccgtggagcc

SEQ ID NO: 986 - DNA, 177 bp, Zea mays
gaaatctttctctcttctttcgcttcttggcagcattcttcccatctacaaggaggttgtttctgaactgaaggcagctggtgcttcatggattcagtttgatgagcctacccttgttaaagaccttgatgttcacgaattggcagcattctcttcagcatatgctgaactagagtc

SEQ ID NO: 987 - DNA, 145 bp, Zea mays
  unsure (1)..(145): unsure at all n locations
ggaggntgttgctgagctgaaggcagctggtgcttcatggattcagcttgatgagcctacccttgttaaagaccttgatgctcacgaattggccgcattctcttcagcatatgctgaactggagtctngttctctggattgaatg

SEQ ID NO: 988 - DNA, 189 bp, Zea mays
  unsure (1)..(189): unsure at all n locations
attcaacttgatgagcctacccttgttaaagaccttgatgctcacgaattggccgcattctcttcagcatatnctgaactggagtcatcgttctcnggattgaatgtgctatcgagacanacttcgctgacatnctgctgagtcctacaagaccctcacatcatgagtggtgtgatncttacggtttcg

SEQ ID NO: 989 - DNA, 532 bp, Zea mays
  unsure (1)..(532): unsure at all n locations
gaggctcgntntnntnnngnaacttnaagggagncttaatggaaagcttgtaccggtccggattcccgggtcgacccacgcgtccgcggacgcgtgggtacaggcttacttcgcagcaaatgctgctgctcaggcctcgaggaaatcctcaccccgtgtgaccaatgaagaagtccagaaggctgctgctgctctcaagggctctgaccaccgccgtgcgaccaacgttagtgctagattggatgcccagcagaagaagcttaacctccccatccttcccaccactacaatcggttcgttcccacaaaccgttgagctcaggagggtccgccgtgagtacaaggcaaaaaagatctctgaggaggaatacgtcactgccatcaaggaggaaatcaacaaggtcgttaagctccaagaagagcttgacattgatgtgcttgtgcatggcgagcctgagagaaacgatatggttgagtacttcggtgagcagctctccggttttgcgttcactgccaatggctgggtgcagtct

SEQ ID NO: 990 - DNA, 441 bp, Zea mays
  unsure (1)..(441): unsure at all n locations
gcttacttcgcagcaaatgctgctgctcaggcctcgaggaaatnctnaccccgtgtgaccaatgaagaagtccagaaggctgctgctgctctcaagggctctgaccaccgccgtgggaccaacgttagtgctagattggatgcccagcagaagaagcttaacctccccatccttcccaccactacaatcggttcgttcccacaaaccgttgagctcaggagggtccgccgtgagtacaaggcaaaaaagatctctgaggaggaatacgtcactgccatcaaggaggaaatcaacaaggtcgttaagcttcaagaagagcttgacattgatgtgcttgtgcatggcgagcctgagagaaacgatatggttgagtacttcggtgagcagctcttcggttttgcgttcactggcaatggctgggtncagtcttatgggtcaagg

SEQ ID NO: 991 - DNA, 524 bp, Zea mays
  unsure (1)..(524): unsure at all n locations
gnnnnnnagtagtttatnnnggggnggggggggggaangggaagnttcaccggtccggaattcccgggtcgacccacgcgtccgatccaggacaccacccagatccacacccacatgtgctactccaacttcaacgacatcatncactngatcatcgacatggacgcggacgtgatcaccatcgagaactcgcggtccgacgagaagctgctctccgtgttccgtgagggtgtcaagtacggcgcgggcatcggccccggtgtctacgacatccactcccccaggatcccgtcggccgaggagatcgccgaccgcatcgacaagatgctggccgtgctggacaccaacatcctctgggtgaaccccgactgcggcctcaagacccgcaagtacacggaggtcaagcccgccctgaccaacatggtctccgctgctaagctcattcgcacccagctcgccaagcgccaaagtgagcacctttttttgcctttttcgtttccgaggagggcgtcgtcgatgccaat

SEQ ID NO: 992 - DNA, 436 bp, Zea mays
  unsure (1)..(436): unsure at all n locations
gaattnccaactgcgatttccaggacaccacccagatccacacccacntgtgctactccaacttcaacgacatcatccactcgatcatcgacatggacgcggacgtgatcaccattgagaactcgcggtccgacgagaagctgctctccgtgttccgcgagggcgtcaagtacggcgcgggcatcggccccggtgtctacgacatccactcccccaggatcccgtcggctgaggagatcgccgaccgcatcgacaagatgctggcggtgctggacaccaacatcctctgggtgaaccccgactgcggccttaagacccgcaagtacacggaggtcaaagcccgcctgaccaacatggtctncgncgctaagctcatncgcacccagntcgccancgccaagtgancacctttttttttggcctttttngnttccga

SEQ ID NO: 993 - DNA, 330 bp, Zea mays
gcagaaaaagctcaaccttcctgtccttcccacaaccacaattggttcattccctcagactgtggaactcaggagggtccgtcgtgagtacaaggcaaagaagatctccgaggaggaatacatcagtgccatcaaggaagaaatcagcaaggttgtcaagatccaagaggagcttgacattgatgtgcttgtgcatggagagccagaaagaaatgacatggttgagtacttcggtgagcaattatctggttttgcattcactgccaacggatgggtgcaatcttatggatcacgttgtgtgaagccacccattatctatggcgatgtcag

SEQ ID NO: 994 - DNA, 438 bp, Zea mays
  unsure (1)..(438): unsure at all n locations
atgacgtctcgcccaatgaaggggnttctgactggcccagtcacaatcctcaactggnccttcgtccggaatgaccagccgaggtttgagacttgctaccagatcgctcttgcgatcaagaaggaagtcgaggatcttgaggctggtggtattcaggttatccaaatcgacgaggctgcactgagagaagggctgccgctccgcaaggctgaacatgcattctacttggactgggctgccactccttcagaattaccaactgcgagatccangacaccacccagatccacacccacatgtgctacttcaacttcaacgacatcatncactcgatcatcgacatggacgccgacgtgaacaccattgagaacttgcgggccgacnagaaacttntnttccgngttncncgaaggccgtnaagtccgggnccgggcatnt

SEQ ID NO: 995 - DNA, 469 bp, Zea mays
  unsure (1)..(469): unsure at all n locations
cacagagcatgacccctcgtcccatgaaggtnatgttgactggtcntntcacaatcctgaactggtcattcgtcaggaacgaccagcctaggtttgagacatgctaccaaatagctcttgcaatcaaaaaggaggttgaggatcttgaggctgctggtattcaggtgatccagatcgatgaggcagctctaagggagggtctgccactacgcaagtcagagcatgcattctacctggactgggctgtccactctttcaggatcaccaactgcggagtccaggacaccacccagatccacacccacatgtgctactccaacttcaacgacatcatccactccatcatcgacatggatgcccgatgtgatcacgatcgagaactcccggtctgaccagaagctactgtccgtcttncgtgagggtgtgaaataccggaactggcattggccctggtgtctacgacattcat

SEQ ID NO: 996 - DNA, 353 bp, Zea mays
  unsure (1)..(353): unsure at all n locations
tggggctgtccactctttcaggatcaccaactgcggagtccaggacaccacccagatccacacccacatgtgctactccaacttcaacgacatcatccactccatcatcgacatggatgccgatgtgatcacgatcgagaactcccggtctgacgagaagctactgtccgtcttccgtgagggtgtgaagtacggagctggcattggccctggtgtctacgacatccactctcctaggattccctccaccgaggagatcgcagaccgcgtcgagaagatgctcgccgtgctcgacaccaacatcctctgggtgaacctgactgtggtctcaagacacgcaatacacggangtc

SEQ ID NO: 997 - DNA, 452 bp, Zea mays
  unsure (1)..(452): unsure at all n locations
gaaatcaacaaggtcgttaagcttcaagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgaccgtgagccgccccaaccccatgaccgttttctggtcgaagacggcacagagcatgacgtctcgcccaatgaaggggatgctgactggcccagtcacaatcctcaactggtccttcgtccggaatgaccagccgaggtttgagacttgctaccagatccgctcttgcgatcaagaaggaaagtcgaggatcttgaagctggtgggtattcaagggtatccaaatcgaccagggcttgcactnaaagaaanggcttnccgnttcgnaa

SEQ ID NO: 998 - DNA, 484 bp, Zea mays
  unsure (1)..(484): unsure at all n locations
ttnnncngcccngnnnnnnnnnnnnnnnnnnnnnnnnnnnnnnnnnnnnnngacatcatccactcgatcatcgacatggacgcggacgtgatcaccatcgagaactcgcggtccgacgagaagctgctctccgtgttccgtgagggtgtcaagtacggcgcgggcatcggccccggtgtctacgacatccactcccccaggatcccgtcggccgaggagatcgccgaccgcatcgacaagatgctggccgtgctggacaccaacatcctctgggtgaaccccgactgcggcctcaagacccgcaagtacacggaggtcaagcccgccctgaccaacatggtctccgctgctaagctcattcgcacccagctcgccagcgccaagtgagcacctttttttgcctttttcgtttccgaagaagggcgtcgtcnatgccaattttgtttccaataaacaaggntncccccccntttnccnccgttnt

SEQ ID NO: 999 - DNA, 353 bp, Zea mays
caaggctgagcatgcattctacttggactgggctgtccactccttcagaattaccaactgcgagatccaggacaccacccagatccacacccacatgtgctactccaacttcaacgacatcatccactcgatcatcgacatggacgcggacgtgatcaccattgagaactcgcggtccgacgagaagctgctctccgtgttccgcgagggcgtcaagtacggcgcgggcatcggccccggtgtctacgacatccactcccccaggatcccgtcggctgaggagatcgccgaccgcatcgacaagatgtggcggtgtggacaccaacatcctctgggtgaacccgattgcggct

SEQ ID NO: 1000 - DNA, 303 bp, Zea mays
cagatcgatgaggcagctctaagggagggtctgccactacgcaagtcagagcatgcattctacctggactgggctgtccactctttcaggatcaccaactgcggagtccaggacaccacccagatccacacccacatgtgctactccaacttcaacgacatcatccactccatcatcgacatggatgccgatgtgatcacgatcgagaactcccggtctgacgagaagctactgtccgtcttccgtgagggtgtgaagtacggagctggcattggccctggtgtctacgacatccactctcct

SEQ ID NO: 1001 - DNA, 347 bp, Zea mays
  unsure (1)..(347): unsure at all n locations
atgaggcttactttgcagccaatgctgctgctcaggcctcaaggagatcatcacctagagtgacaaacgaggaggtccaaaaggctgcagctgctttgaagggttctgacnnccgccgtgctactactgttgctgctagattggatgctcagcagaaaaagctcaaccttcctgtccttcccacaaccacaattgnntcattccctcagactgtggaactcaggagggtccgtcgtgagtacaaggcaaagaagatctccgaggaggaatacatcagtgccatcaaggaagaaatcagcaaggttgtcaagatccaagaggagcttgacattgatgtgcttgtgcat

SEQ ID NO: 1002 - DNA, 319 bp, Zea mays
caaggcaaagaagatctccgaggaggaatacatcagtgccatcaaggaagaaatcagcaaggttgtcaagatccaagaggagcttgacattgatgtgcttgtgcatggagagccagaaagaaatgacatggttgagtacttcggtgagcaattatctggttttgcattcactgccaacggatgggtgcaatcttatggatcacgttgtgtgaagccacccattatctatggcgatgtcagccggccgaaccccatgactgttttctggtccaagacggcacagagcatgaccgctcgtcccatgaagggaatgttgact

SEQ ID NO: 1003 - DNA, 379 bp, Zea mays
  unsure (1)..(379): unsure at all n locations
caagcttgtcgtatcaacttcctgctcgctcatgcacaccgctgtggatcttgtgaacgagactaagcttgacagcgagattaagtcttggcttgcttttgctgcccagaaggttgttgaggttgatgctcttgctaaggcattggctggtcaaaaggatgaggcttacttcgcagcaaatgctgctgctcaggcctcgaggaaatcctcaccccgtgtgaccaatgaagaagtccagaaggctgctgctgctctcaagggctctgaccaccgccgtgggaccaacgttagtgctagattggatgcccagcagaagaagcttaacctccccatccttcccaccactacaatcgggttcggnnnnnnnnnnnnnnnnnnt

SEQ ID NO: 1004 - DNA, 351 bp, Zea mays
  unsure (1)..(351): unsure at all n locations
caggacaccacccagatccacacccacatgtgctactccaacttcaacgacatcatccactccatcatcgacatggatgccgatgtgatcacgatcgagaactcccggtctgacgagaagctactgtccgtcttccgtgagggtgtgaagtacggagctggcattggccctggtgtctacgacatccactctcctaggattccctccaccgaggagatcgcagaccgcgtcgagaagatgctcgccgtgctcgacaccaacatcctctgggtgaaccctgactgtggtctcaagacacgcaatacacggaggtcaagcccgncctgaccaacaggtctcggcaacaagctc

SEQ ID NO: 1005 - DNA, 302 bp, Zea mays
atcgacgaggctgcactgagagaagggctgccgctccgcaaggctgagcatgcattctacttggactgggctgtccactccttcagaatcaccaactgcgagatccaggacaccacccagatccacacccacatgtgctactccaacttcaacgacatcatccactcgatcatcgacatggacgcggacgtgatcaccatcgagaactcgcggtccgacgagaagctgctctccgtgttccgtgagggtgtcaagtacggcgcgggcatcggccccggtgtctacgacatccactcccccag

SEQ ID NO: 1006 - DNA, 296 bp, Zea mays
gcagaaaaagctcaaccttcctgtccttcccacaaccacaattggttcattccctcagactgtggaactcaggagggtccgtcgtgagtacaaggcaaagaagatctccgaggaggaatacatcagtgccatcaaggaagaaatcagcaaggttgtcaagatccaagaggagcttgacattgatgtgcttgtgcatggagagccagaaagaaatgacatggttgagtacttcggtgagcaattatctggttttgcattcactgccaacggatgggtgcaatcttatggatcacgtt

SEQ ID NO: 1007 - DNA, 537 bp, Zea mays
  unsure (1)..(537): unsure at all n locations
gntngagtcnggcttcggcnttgatgatngcgtantcnttcngnangccgntnngaattcccgggtcgacccacgcgtccggnaggaatacgtcactgccatcaaggaggaaattaacaaggtcgttaagcttcaagaagagcttgacattgatgtgcttgtgcatggngagcctgagagaaacgatatggttgagtacttcggtgagcagctctncggttttgcgttcactgccaatggctgggtgcagtcttatgggtcaaggtgcgtcaagcctccgatcatctacggtgacgtgagccgtcccaaccccatgaccgttttctggtcgaagacggcncanagcatgacgtctcgcccaatgaaaggggatgctgactngcccagtcacaatcctcaactggtnctttgtcccggaatnaccagcccagggtttgaganttgctaccagaatcggcttcttgcgatcaagaaagggaagtncaagggatctttgangntgggtggtntttaangtttattncaaaatcgacnaag

SEQ ID NO: 1008 - DNA, 347 bp, Zea mays
  unsure (1)..(347): unsure at all n locations
cgttttctggtcgaagacgggcgcagagcatgacgtctcgcccaatgaaggggatgctgactggcccagtcacaatcctcaactggtccttcgtccggaacgaccagccgaggtttgagacttgctaccagatcgctcttgcgatcaagaaggaagtcgaggatcttgaggctggtggtattcaggttatccaaatcgacgaggctgcactgagagaagggctgccgctccgcaaggctgagcatgcattctacttggactgggctgtccactccttcagaattaccaactgcgagatncaggacaccaccagatccacacccacatgtgctactccaacttcaacg

SEQ ID NO: 1009 - DNA, 339 bp, Zea mays
gaggatcttgaggctgctggtattcaggtgatccagattgatgaggcagctctaagggagggtctgccactgcgcaagtcagagcatgcattctacctggactgggctgtccactctttcagaatcaccaactgcggagtccaggacaccacccagatccacacccatatgtgctactccaacttcaacgacatcatccactccatcatcgacatggacgcagatgtgatcaccatcgagaactcccggtccgacgagaagctactgtccgtgttccgcgaggtgtgaagtacggagctggaatcggtccagtgtctaggaatccactcgccaagtccc

SEQ ID NO: 1010 - DNA, 313 bp, Zea mays
  unsure (1)..(313): unsure at all n locations
ccgctccgcaaggctgagcatgcattctacttggactgggctgtccactccttcagaaacaccaactgcgagatccaggacaccacccagatccacacccacatgtgctactccaacttcaacgacatcatccactcgatcatcgacatggacgcggacgtgatcaccatcgagaactcgcggtccgacgagaagctgctctccgtgttccgtgagggtgtcaagtacggcgcgggcatcggccccggtgtctacgacatccactcccccaggatcccgtcggccgangagatcgccgaccgcatcgacaaga

SEQ ID NO: 1011 - DNA, 310 bp, Zea mays
caacaaggtcgttaagcttcaagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagacggcacagagcatgacgtctcgcccaatgaaggggatgctgactggcccagtcacaatcctcaactggtccttcgtccggaatgaccag

SEQ ID NO: 1012 - DNA, 319 bp, Zea mays
acgatatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagacggcgcagagcatgacgtctcgcccaatgaaggggatgctgactggcccagtcacaatcctcaactggtccttcgtccggaatgaccagccgaggtttgagacttgctaccagatcgctcttgcgatcaagaaggaagtcgaggatctcgaggctggtggtattca

SEQ ID NO: 1013 - DNA, 315 bp, Zea mays
ctagattggatgcccagcagaagaagcttaacctccccatccttcccaccactacaatcggttcgttcccacaaaccgttgagctcaggagggtccgccgtgagtacaaggcaaaaaagatctctgaggaggaatacgtcactgccatcaaggaggaaatcaacaaggtcgttaagcttcaagaagagcttgacattgatgtgcttgtgcatggcgagcctgagagaaacgatatggttgagtacttcggtgagcagctctccggttttgcgttcactgccaatggctgggtgcagtcttatgggtcaaggtgcg

SEQ ID NO: 1014 - DNA, 505 bp, Zea mays
  unsure (1)..(505): unsure at all n locations
agggtgtnaggggggggaagaaaggaactgtcgtaccggtccggaattcccgggtcgacccacgcgtccgcttgtccgtggaacccaaactcttgggcttgtcacgagtgctggtttccctgctggaaagtacctctttgctggtgttgtggatggacgcaacatctgggctgatgatcttgctacatctctcagcactctccagtctcttgaggctgttgttgggaaggacaagcttgtcgtatcaacttcctgctcgctcatgcacaccgctgtggatcttgtgaacgagactaagcttgacagcgagattaagtcttggcttgcttttgctgcccagaaggttgttgaggttgatgctcttgctaaggcattggctggtcaaaaggatgaggcttacttcgcagcaaatgctgctgctcaagcctcgaggaaatcctnaccccgtgtgaccaatgaaaaatccagaangctgctgctgntcttnaaggcttttgaccaccgc

SEQ ID NO: 1015 - DNA, 298 bp, Zea mays
gccgtgaatacaaggcaaagaagatcaccgaggacgaatacatcagtgccatcaaggaagaaatcagcaaggttgtcaagatccaagaggagcttgacattgatgtgcttgtgcatggagagccagagagaaatgacatggttgagtacttcggtgagcaattatctggttttgcgttcactgccaacggatgggtgcaatcctatggatcacgctgtgtgaagccacccattatctatggtgatgtcagccggccgaaccccatgactgttttctggtccaagatggcacagagcat

SEQ ID NO: 1016 - DNA, 493 bp, Zea mays
  unsure (1)..(493): unsure at all n locations
gggnnnnngnaangttacgttncgggnccggtccaaaataaacgggtcgangcacgcgtccgggccaacttgtcctccaaccttgattcctgacaaaattggctggcattctctgctgcatacgcagaaacttgaatctgtactttctggattgaatgtgcttgttgagacttactttgctgatgttcctgctgagtcctacaagaccctaacatctctgagcagtgtgactgcttatggttttgatcttgtccgtggaacccaaactcttgggcttgtcacgagtgctggtttccctgctggaaagtacctctttgctggtgttgtggatggacgcaacatctgggctgatgatcttgctacatctctcagcactctccagtctcttgaggctgttgttgggaaggacaagcttgtcgtatcaacttcctgctcgctcatgcacaccgctgtggatcttgtgaacgagactaagcttgacagcgagattaag

SEQ ID NO: 1017 - DNA, 356 bp, Zea mays
  unsure (1)..(356): unsure at all n locations
cgccgctgcgccgttctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtccttgacaccactgccatgctcggcgctgtccccgaacgttactcatggactggangagagattgganttgacacctacttctccatggccagggcaacgcactgttcctgc

SEQ ID NO: 1018 - DNA, 344 bp, Zea mays
  unsure (1)..(344): unsure at all n locations
gcctaccatctgttcagacaagcttgtcgtatcaacttcctgctcgctcatgcacaccgctgtggatcttgtgaacgagactaagcttgacagcgagattaagtcttggcttgcttttgctgcccagaaggttgttgaggttgatgctcttgctaaggcattggctggtcaaaaggatgaggcttacttcgcagcaaatgctgcagctcaggcctcgaggaaatcctcaccccgtgtgaccaatgaagaagtccagaaggctgctgctgctctcaagggctctgaccaccgccgtgcgaccaacgttagtgctagattngatgcccagcagaagaagcctaacc

SEQ ID NO: 1019 - DNA, 292 bp, Zea mays
ccgccgtgctaccactgttgctgctagattggatgctcagcagaaaaagctcaaccttcctgtccttcccacaaccacaattggttcattccctcagactgtggaactcaggagggtccgtcgtgagtacaaggcaaagaagatctccgaggaggaatacatcagtgccatcaaggaagaaatcagcaaggttgtcaagatccaagaggagcttgacattgatgtgcttgtgcatggagagccagaaagaaatgacatggttgagtacttcggtgagcaattatctggtttt

SEQ ID NO: 1020 - DNA, 312 bp, Zea mays
accagccgaggtttgagacttgctaccagatcgctcttgcgatcaagaaggaagtcgaggatctcgaggctggtggtattcaggttatccaaatcgacgaggctgcactgagagaagggctgccgctccgcaaggctgagcatgcattctacttggactgggctgtccactccttcagaatcaccaactgcgagatccaggacaccacccagatccacacccacatgtgctactccaacttcaacgacatcatccactcgatcatcgacatggacgcggacgtgatcaccatcgagaactcgcggtccgacg

SEQ ID NO: 1021 - DNA, 286 bp, Zea mays
caagatccaagaggagcttgacattgatgtgcttgtgcatggagagccagagagaaatgacatggttgagtacttcggtgagcaattatctggttttgcgttcactgccaacggatgggtgcaatcctatggatcacgctgtgtgaagccacccattatctacggtgatgtcagccggccgaaccccatgactgttttctggtccaagatggcacagagcatgacccctcgtcccatgaagggaatgttgactggtccggtcacaatcctcaactggtcattcgtc

SEQ ID NO: 1022 - DNA, 287 bp, Zea mays
atgtgctactccaacttcaacgacatcatccactccatcatcgacatggatgccgatgtgatcacgatcgagaactcccgatctgacgagaagctactgtccgtcttccgtgagggtgtgaagtacggagctggcattggccctggtgtctacgacatccactctcctaggattccctccaccgaggagatcgcagaccgcgtcgagaagatgctcgccgtgctggacaccaacatcctctgggtgaaccctgactgtggtctcaagacacgcaagtacacggaggt

SEQ ID NO: 1023 - DNA, 295 bp, Zea mays
  unsure (1)..(295): unsure at all n locations
caaggntgtcaagatccaagaggagcttgacattgatgtgcttgtgcatggagagccagagagaaatgacatggttgagtacttcggtgagnaattatctggttttgcgttcactgccaacggatgggtgcaatcctatggatcacgctgtgtgaagccacccattatctatggtgatgtcagccggccgaaccccatgactgttttctggtccaagatggcacagagcatgacccctcgtcccatgaagggaatgttgactggtccggtcacaatcctgaactggtcattcgtc

SEQ ID NO: 1024 - DNA, 299 bp, Zea mays
agaagatcaccgatgacgaatacatcagtgccatcaaggaagaaatcagcaaggttgtcaagatccaagaggagcttgacattgatgtgcttgtgcatggagagccagagagaaatgacatggttgagtacttcggtgagcaattatctggttttgcgttcactgccaacggatgggtgcaatcctatggatcacgctgtgtgaagccacccattatctatggtgatgtcagccggccgaaccccatgactgttttctggtccaagatggcacagagcatgacccctcgtcccatgaag

SEQ ID NO: 1025 - DNA, 312 bp, Zea mays
tgagtacaaggcaaaaaagatctctgaggaggaatacgtcactgccatcaaggaggaaatcaacaaggtcgttaagcttcaagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagaggcacagagcatgacgtctcgcccaatgaag

SEQ ID NO: 1026 - DNA, 299 bp, Zea mays
aaagatctctgaggaggaatacgtcactgccatcaaggaggaaatcaacaaggtcgttaagcttcaagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagacggcacagagcatgacgtctcgcccaatgaagg

SEQ ID NO: 1027 - DNA, 310 bp, Zea mays
gtgtgaccaatgaagaagtccagaaggctgctgctgctctcaagggctctgaccaccgccgtgggaccaacgttagtgctagattggatgcccagcagaagaagcttaacctccccatccttcccaccactacaatcggttcgttcccacaaaccgttgagctcaggagggtccgccgtgagtacaaggcaaaaaagatctctgaggaggaatacgtcactgccatcaaggaggaaatcaacaaggtcgttaagcttcaagaagagcttgacattgatgtgcttgtgcatggcgagcctgagagaaacgg

SEQ ID NO: 1028 - DNA, 305 bp, Zea mays
gtctcgcccaatgaaggggatgctgactggcccagtcacaatcctcaactggtccttcgtccggaatgaccagccgaggtttgagacttgctaccagatcgctcttgcgatcaagaaggaagtcgaggatcttgaggctggtggtattcaggttatccaaatcgacgaggctgcactgagagaagggctgccgctccgcaaggctgagcatgcattctacttggactgggctgtccactccttcagaattaccaactgcgagatccaggacaccacccagatccacacccacatgtgctactcca

SEQ ID NO: 1029 - DNA, 330 bp, Zea mays
  unsure (1)..(330): unsure at all n locations
cgctgaggatctggagaaggttgctaccgacctcagggccagtatctggaagcagatggctgatgctgggatcaagtacatccccagcaacaccttctcgtactatgaccagntccttgacaccactgccatgctcggcgctgtccccgaacgctactcatggactggaggagagattgggtttgacacctacttctccatggccaggggcaacgccactgtccctgctatggagannaccaagtggtttgacaccaactaccactttattgtccctgaattgggcccaaacaccaagttctcctatgcttctcacaaggctgttaacga

SEQ ID NO: 1030 - DNA, 269 bp, Zea mays
gcattctacctggactgggctgtccactctttcagaatcaccaactgcggagtccaggacaccacccagatccacacccatatgtgctactccaacttcaacgacatcatccactccatcatcgacatggacgcagatgtgatcaccatcgagaactcccggtccgacgagaagctactgtccgtgttccgcgagggtgtgaagtacggagctggaatcggtccaggtgtctacgacatccactcgcccaggatcccctccaccgagga

SEQ ID NO: 1031 - DNA, 311 bp, Zea mays
ctcgcccaatgaaggggatgctgactggcccagtcacaatcctcaactggtccttcgtccggaatgaccagccgaggtttgagacttgctaccagatcgtcttgcgatcaagaaggaagtcgaggatctcgaggctggtggtattcaggttatccaaatcgacgaggctgcactgagagaagggctgccgctccgcaaggctgagcatgcattctacttggactgggctgtccactccttcagaatcaccaactgcgagatccaggacaccacccagatccacacccacatgtgctactccaacttcaacg

SEQ ID NO: 1032 - DNA, 382 bp, Zea mays
  unsure (1)..(382): unsure at all n locations
gggacaccacccagatccacacccacatgtgctactccaactttcaacgacatcatccactcgatcatcgacatggacgcggacgtgatcaccattgagaactcgcggtccgacgagaagctgctctccgtgntccgcgagggcgtcaagtacggcgcgggcatcggcnccggtgtctacgacatccactcccccaggatcncgtcggctgangagatcgccgaccgcatcgacaagatgctggcggtgctggacancaacatcctctgggtgaaccccgactgcngcctcaagacccgcaagtacacggagtcaagcccgcntgancaacatggtctccgccgtaagctcatccgnaccagctcgccagcgcaatganaac

SEQ ID NO: 1033 - DNA, 292 bp, Zea mays
aggatcttgaggctggtggtattcaggttatccaaatcgacgaggctgcactgagagaagggctgccgctccgcaaggctgagcatgcattctacttggactgggctgtccactccttcagaattaccaactgcgagatccaggacaccacccagatccagacccacatgtgctactccaacttcaacgacatcatccactcgatcatcgacatggacgcggacgtgatcaccattgagaactcgcggtccgacgagaagctgctctccgtgttccgcgagggcgtcaagta

SEQ ID NO: 1034 - DNA, 320 bp, Zea mays
cttgacagcgagattaagtcttggcttgcttttgctgcccagaaggttgttgaggttgatgctcttgctaaggcattggctggtcaaaaggatgaggcttacttcgcagcaaatgctgcagctcaggcctcgaggaaatcctcaccccgtgtgaccaatgaagaagtccagaaggctgctgctgctctcaagggctctgaccaccgccgtgcgaccaacgttagtgctagattggatgcccagcagaagaagcttaacctccccatccttcccaccactacaatcggttcgttcccacaaaccgttgagctcaggagggt

SEQ ID NO: 1035 - DNA, 305 bp, Zea mays
acttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagacggcacagagcatgacgtctcgcccaatgaaggggatgctgactggcccagtcacaatcctcaactggtccttcgtccggaatgaccagccgaggtttgagacttgctaccagatcgctcttgcgatcaagaaggaagtcgaggatcttgaggctggtggtattcag

SEQ ID NO: 1036 - DNA, 278 bp, Zea mays
  unsure (1)..(278): unsure at all n locations
caagaggagcttgacattgatgtgcttgtgcatggagagccaganagaaatgacatggttgagtacttcggtgagcaattatctggttttgcgttcactgccaacggatgggtgcaatcctatggatcacgctgtgtgaagccacccattatctatggtgatgtcagccggccgaaccccatgactgttttctggtccaagatggcacagagcatgacccctcgtcccatgaagggaatgttgactggtccggtcacaatcctgaactggtcattcgt

SEQ ID NO: 1037 - DNA, 298 bp, Zea mays
ctctgaggaggaatacgtcactgccatcaaggaggaaatcaacaaggtcgttaagcttcaagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagacggcacagagcatgacgtctcgcccaatgaaggggatg

SEQ ID NO: 1038 - DNA, 298 bp, Zea mays; identical to SEQ ID NO: 1037

SEQ ID NO: 1039 - DNA, 447 bp, Zea mays
  unsure (1)..(447): unsure at all n locations
ggcgctcggtgttgataccgtgccagtacttgttggaccagtctcgtacctgttgcngnnaaagcctgccaagggtgtggagaagggattccctcttctttcccttcttagcagcatcctcccagtctacaaggaggtcattgctgagttgaaggcagctggggcttcatggattcagtttgatgagcccactcttgtcctcgaccttgattctgacaaattggctgcattctctgctgcatatgcagaacttgaatctgtactttctggattgaatgtgcttgttgagacttactttgctgatgttcctgctgagtcctacaagaccctaacatccctgaacagtgtgactgcttatgggtttgatcntgtccggggacccnaaactnttgggcttggcaccaaggctggnttccttnttggaaanaaccctntttgctgggggtg

SEQ ID NO: 1040 - DNA, 301 bp, Zea mays
ctccaagaagagcttgacattgatgtgcttgtgcatggcgagcctgagagaaacgatatggttgagtacttcggtgagcagctcctccggttttgcgttcactgccaatggctgggtgcagtcttatgggtcaaggtgcgtcaagcctccgatcatctacggtgacgtgagccgccccaaccccatgaccgttttctggtcgaagacggcgcagagcatgacgtctcgcccaatgaaggggatgctgactggcccagtcacaatcctcaactggtccttcgtccggaatgaccagccgagg

SEQ ID NO: 1041 - DNA, 297 bp, Zea mays
caaggtcgttaagctccaagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagaggcgcagagcatgacgtctcgcccaatgaaggggatgctgactggcccagtcacaatcctcaactggtccttcgtccgg

SEQ ID NO: 1042 - DNA, 548 bp, Zea mays
  unsure (1)..(548): unsure at all n locations
gnnnaggtgntnannggggnnggaaggaacnttttaccggtccggaattcccgggtcgacccacgcgtccgcccacgcgtccgctcgatcatcgacatggacgcggacgtgatcaccattgagaactcgcggnccgacgagaagctgctctccgtgttccgcgagggcgtcaagtacggcgcgggcatcggccccggtgtctacgacatccactcccccaggatcccgtcggctgaggagatcgccgaccgcatcgacaagatgctggcggtgctggacaccaacatcctctgggtgaaccccgactgcggcctcaagacccgcaagtacacggaggtcaagcccgcctgaccaacatggtctccgccgctaagctcatccgcacccagcttgncagcgccaagtgagcaccnttttttttgcctttttcggtttcgaagaaggcgtcgtcgatgccaatttggtttccaataaaaaggctttgcccgccgtctgtgnactccgctgnggtaaggtaagaagtttcttaaaaaaaaaaaaangggggc

SEQ ID NO: 1043 - DNA, 303 bp, Zea mays
gacggcgcagagcatgacgtctcgcccaatgaaggggatgctgactggcccagtcacaatcctcaactggtccttcgtccggaatgaccagccgaggtttgagacttgctaccagatcgctcttgcgatcaagaaggaagtcgaggatctcgaggctggtggtattcaggttatccaaatcgacgaggctgcactgagagaagggctgccgctccgcaaggctgagcatgcattctacttggactgggctgtccactccttcagaatcaccaactgcgagatccaggacaccacccagatcca

SEQ ID NO: 1044 - DNA, 602 bp, Zea mays
  unsure (1)..(602): unsure at all n locations
gcggacgtgatcaccattgagaactcgcggtccgacgagaagctgctctccgtgttccgcgagggcgtcaagtacggcgcgggcatcggccccggtgtctacgacatccactcccccaggatcccgtcggctgaggagatcgccgaccgcatcgacaagatgctggcggtgctggacaccaacatcctctgggtgaaccccgactgcggcctcaagacccgcaagtacacggaggtcaagcccgccctgaccaacatggtctccgccgctaagctcatccgcacccagctcgccagcgccaagtgagcaccttttttttgcctttttcgtttccgaggagggcgtcgtcgatgccaatttgtttccaataaacagggctgtgcccgccgttctgttgtactccgtctgtggttaggttagtagttttcttgatctcgcccccacgcggtacctgttttactactctctgtttggtggtttctgaggcaagttgcccgtgtacttgtatcgtaaaaaccgagtgggacatctgcatcgtttcatctgncaccactnccccgaggtgtgctggttcacggctcaaagaaagatgtcntatcggc

SEQ ID NO: 1045 - DNA, 273 bp, Zea mays
ggttgtcaagatccaagaggagcttgacattgatgtgcttgtgcatggagagccagagagaaatgacatggttgagtacttcggtgagcaattatctggttttgcgttcactgccaacggatgggtgcaatcctatggatcacgctgtgtgaagccacccattatctatggtgatgtcagccggccgaaccccatgactgttttctggtccaagatggcacagagcatgacccctcgtcccatgaagggaatgttgactggtccggtcacaat

SEQ ID NO: 1046 - DNA, 328 bp, Zea mays
  unsure (1)..(328): unsure at all n locations
atcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtccttgacaccactgccatgctcggcgctgtccccgaacgttactcatgnactggaggagagattggatttgacacctact

SEQ ID NO: 1047 - DNA, 297 bp, Zea mays
aaaaaagatctctgaggaggaatacgtcactgccatcaaggaggaaatcaacaaggtcgttaagcttcaagaagagcttgacattgatgtgcttgtgcatggcgagcctgagagaaacgatatggttgagtacttcggtgagcagctctccggtttggcgttcactgccaatggctgggtgcagtcttatgggtcaaggtgcgtcaagcctccgatcatctacggtgacgtgagccgccccaaccccatgaccgttttctggtcgaagacggcacagagcatgacgtctcgcccaat

SEQ ID NO: 1048 - DNA, 264 bp, Zea mays
ctctttcagaatcaccaactgcggagtccaggacaccacccagatccacacccatatgtgctactccaacttcaacgacatcatccactccatcatcgacatggacgcagatgtgatcaccatcgagaactcccggtccgacgagaagctactgtccgtgttccgcgagggtgtgaagtacggagctggaatcggtccaggtgtctacgacatccactcgcccaggatcccctccaccgaggagatcgcggaccgcgtcaacaa

SEQ ID NO: 1049 - DNA, 471 bp, Zea mays
  unsure (1)..(471): unsure at all n locations
gggnnnnacgttantcngcgngnncggtcanaggacncacnggccgaggcncgcgtccacaccnatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacaccttctcgtactatgaccaggtccttgacaccactgccatgctcggcgctgtccccgaacgctactcatggactggaggagagattgggtttgacacctaacttctccatggccaagggcaacgccactgtccctgctatgggagataccaanttggttttggacacaaactaccaacttt

SEQ ID NO: 1050 - DNA, 291 bp, Zea mays
cgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtccttgacaccactgccatgctcggcgctgtccccgaacgttactcatggactggaggagagattggat

SEQ ID NO: 1051 - DNA, 349 bp, Zea mays
  unsure (1)..(349): unsure at all n locations
atccactccatcatcgacatggatgccgatgtgatcacgatcgagaactcccgatctgacgagaagctnactgtccgtcttccgtgagggtgtgaagtacggagctgggcattggccctggtgtctacgacatccactctcctaggattcacctccaccgaggagatcgcagaccgcgtcgagaagatgctcgccgtgctggacaccaacatcctctgggtgaaccctgactgtggtctcaanacacgcaagtacacggaggtcaagcccgccctgaccaacatggtctcggccancaagctcatccgcacccagcttgccaacgcgaaatgagtcgtttgatagctcc

SEQ ID NO: 1052 - DNA, 333 bp, Zea mays
  unsure (1)..(333): unsure at all n locations
gttctagcatctggaagcaaatgtcagaagctgggatcaagtacattcccagcaacaccttctcgtactatgaccaggtccttgataccacggccatgcttggtgctgtcccagagcgctactcttggactggaggcgagattggcttgagcacctatttctcaatggccaggggaaatgccactgtccctgctatggagatgaccaagtggtttgatacaaactaccactttattgtccctgaattggcccaagcaccaagttcacatacgcttctcacaangctgtttctgagtacaaggaggcaaaagcgctcggtattgatatgtccca

SEQ ID NO: 1053 - DNA, 299 bp, Zea mays
ctggaaagtacctctttgctggtgttgtggatggacgcaacatctgggctgatgatcttgctacatctctcagcactctccagtctcttgaggctgttgttgggaaggacaagcttgtcgtatcaacttcctgctcgctcatgcacaccgctgtggatcttgtgaacgagactaagcttgacagcgagattaagtcttggcttgcttttgctgcccagaaggttgttgaggttgatgctcttgctaaggcattggctggtcaaaaggatgaggcttacttcgcagcaaatgctgcagct

SEQ ID NO: 1054 - DNA, 281 bp, Zea mays
gctaccagatcgctcttgcgatcaagaaggaagtcgaggatcttgaggctggtggtattcaggttatccaaatcgacgaggctgcactgagagaagggctgccgctccgcaaggctgagcatgcattctacttggactgggctgtccactccttcagaattaccaactgcgagatccaggacaccacccagatccacacccacatgtgctactccaacttcaacgacatcatccactcgatcatcgacatggacgcggacgtgatcaccattgagaatcgg

SEQ ID NO: 1055 - DNA, 305 bp, Zea mays
cgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtccttgacaccactgccatgctcggcgctgtccccgaacgttactcatggactggaggagaga

SEQ ID NO: 1056 - DNA, 292 bp, Zea mays
ggctggtcaaaaggatgaggcttacttcgcagcaaatgctgctgctcaggcctcgaggaaatcctcaccccgtgtgaccaatgaagaagtccagaaggctgctgctgctctcaagggctctgaccaccgccgtgggaccaacgttagtgctagattggatgcccagcagaagaagcttaacctccccatccttcccaccactacaatcggttcgttcccacaaaccgttgagctcaggagggtccgccgtgagtacaaggcaaaaaagatctctgaggaggaatacgtcact

SEQ ID NO: 1057 - DNA, 279 bp, Zea mays
atcaagaaggaagtcgaggatcttgaggctggtggtattcaggttatccaaatcgacgaggctgcactgagagaagggctgccgctccgcaaggctgagcatgcattctacttggactgggctgtccactccttcagaattaccaactgcgagatccaggacaccacccagatccacacccacatgtgctactccaacttcaacgacatcatccactcgatcatcgacatggacgcggacgtgatcaccattgagaactcgcggtccgacgagaagctg

SEQ ID NO: 1058 - DNA, 286 bp, Zea mays
atcgctcttgcgatcaagaaggaagtcgaggatctcgaggctggtggtattcaggttatccaaatcgacgaggctgcactgagagaagggctgccgctccgcaaggctgagcatgcattctacttggactgggctgtccactccttcagaatcaccaactgcgagatccaggacaccacccagatccacacccacatgtgctactccaacttcaacgacatcatccactcgatcatcgacatggacgcggacgtgatcaccatcgagaactcgcggtccgacgaga

SEQ ID NO: 1059 - DNA, 269 bp, Zea mays
  unsure (1)..(269): unsure at all n locations
caagatccaagaggagcttgacattgatgtgcttgtgcatggagagccagagagaaatgacatggttgagtacttcggtgagcaattatctggttttgcgttcactgccaacggatgggtgcaatcctatggatcacgctgtgtgaagccacccattatctatggtgatgtcagccggncgaaccccatgactgttttctggtccaagatggcacagagcatgacccctcgtcccatgaagggaatgttgactggtccggtcacaatcc

SEQ ID NO: 1060 - DNA, 323 bp, Zea mays
gcaacatctggggctgatgatcttgctacatctctcagcactctccagtctcttgaggctgttgttgggaaggacaagcttgtcgtatcaacttcctgctcgctcatgcacaccgctgtggatcttgtgaacgagactaagcttgacagcgagattaagtcttggcttgcttttgctgcccagaaggttgttgaggttgatgctcttgctaaggcattggctggtcaaaaggatgaggcttacttcgcagcaaatgctgcagctcaggcctcgaggaaatcctcaccccgtgtgaccaatgaagaagtccagaaggctgctgc

SEQ ID NO: 1061 - DNA, 287 bp, Zea mays
  unsure (1)..(287): unsure at all n locations
angatcttgaggctgctggtattcaggtgatccagattgatgaggcagctctaagggagggtctgccactgcgcaagttagagcatgcattctacctggactgggctgtccactctttcagaatcaccaactgcggagtccaggacaccacccagatccacacccatatgtgctactccaacttcaangacatcatccactccatcatcgacatggacgcagatgtgatcaccatcgagaactcccggtccgacgagaagctactgtccgtgttccgcgaggtgtga

SEQ ID NO: 1062 - DNA, 295 bp, Zea mays
  unsure (1)..(295): unsure at all n locations
cctcgcatgggccccaagagggagctcaagtttgcacttgagtctttctgggatgggaagagcaccgctgaggatntggagaaggttgctaccgacctcagggccagtatctggaagcagatggctgatgctgggatcaagtacatccccagcaacaccttctcgtactatgaccaggtccttgacaccactgccatgctcggcgctgtccccgaacgctactcatggactggaggagagattgggtttgacacctacttctccatggccaggggcaacgccactgtccctgcta

SEQ ID NO: 1063 - DNA, 304 bp, Zea mays
gtcagagcatgcattctacctggactgggctgtccactctttcaggatcaccaactgcggagtccaggacaccacccagatccacacccacatgtgctactccaacttcaacgacatcatccactccatcatcgacatggatgccgatgtgatcacgatcgagaactcccgatctgacgagaagctactgtccgtcttccgtgagggtgtgaagtacggagctggcattggccctggtgtctacgacatccatctcctaggattccctccaccgaggagatcgcagaccgcgtcgagaagatgc

SEQ ID NO: 1064 - DNA, 293 bp, Zea mays
ctgcgagatccaggacaccacccagatccacacccacatgtgctactccaacttcaacgacatcatccactcgatcatcgacatggacgcggacgtgatcaccatcgagaactcgcggtccgacgagaagctgctctccgtgttccgggggtgtcaagtacggcgcgggcatcggccccggtgtctacgacatccactcccccaggatcccgtcggccgaggagatcgccgaccgcatcgacaagatgctggccgtgctggacaccaacatcctctgggtgaaccccgactgc

SEQ ID NO: 1065 - DNA, 285 bp, Zea mays
tcttggcttgcttttgctgcccagaaggttgttgaggttgatgctcttgctaaggcattggctggtcaaaaggatgaggcttacttcgcagcaaatgctgctgctcaggcctcgaggaaatcctcaccccgtgtgaccaatgaagaagtccagaaggctgctgctgctctcaagggctctgaccaccgccgtgggaccaacgttagtgctagattggatgcccagcagaagaagcttaacctccccatccttcccaccactacaatcggttcgttcccacaaacc

SEQ ID NO: 1066 - DNA, 285 bp, Zea mays
  unsure (1)..(285): unsure at all n locations
gggctgtccactccttcagaattaccaactgcgagatccaggacaccacccagatccacacccacatgtgctactccaacttcaacgacatcatccactcgatcatcgacatggacgcggacgtgatcaccattgagaactcgcggtccgacgagaagctgctctccgtgttccgcgagggcgtcaagtatggcgcgggcatcggccccggtgtctacgacatccactcccccaggatcccgtcggctgaggagatcgccgaccgcatcgacaagatntggcggt

SEQ ID NO: 1067 - DNA, 277 bp, Zea mays
tctggaagcagatggctgatgctgggatcaagtacatccccagcaacactttctcgtactatgaccaggtccttgacaccactgccatgctcggcgctgtccccgaacgttactcatggactggaggagagattggatttgacacctacttctccatggccaggggcaacgccactgttcctgctatggagatgaccaagtggtttgacaccaactaccactttattgtccctgaattgggcccaaacaccaagttctcctatgcttctcacaaggc

SEQ ID NO: 1068 - DNA, 280 bp, Zea mays
  unsure (1)..(280): unsure at all n locations
cccagatccacacccacatgngcncgtccaacttcaacgacatcatccactcgatcatcgacanggacgcggacgtgatcaccatcgagaactcgcggtccgacgagaagctgctctccgtgttccgtgagggtgtcaagtacggcgcgggcatcggccccggtgtctacgacatccactcccccaggatcccgtcggccgaggagatcgccgaccgcatcgacaagatgctggccgtgctggacaccaacatcctctgggtgaaccccgactgcggcct

SEQ ID NO: 1069 - DNA, 297 bp, Zea mays
  unsure (1)..(297): unsure at all n locations
cattgatntgcttgtgcatggcgagcctganagaaacgatatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagaggcgcagagcatgacgtctcgcccaatgaaggggatgctgactggnccagtcacaatcctcaactggtccttcgtccggaatgaccagccgaggtttgaaactgcnaac

SEQ ID NO: 1070 - DNA, 289 bp, Zea mays
cgtcactgccatcaaggaggaaatcaacaaggtcgttaagcttcaagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagaggcacagagcatgacgtctcgcccaatgaaggggatgctgactg

SEQ ID NO: 1071 - DNA, 486 bp, Zea mays
  unsure (1)..(486): unsure at all n locations
gctcagcagaaaaagctcaaccttccngtccnncccacaaccacaattggttcattcccggaaacggtggaactcaggngggttcgncgtgaatacaaggcaaagaagatcaccgaggacgaatacatcagtgccatcaaggaagaaatcagcaaggtngtcaagatccaataggagctngacattgatgtgcttgtgcatggagagccagagagaaatgacatggttgagtacttcggngagcaattatctggttttagcgttcactgccaacggatgggtgcaatnctattgatcacgctgtggtgaagccacccattatctatgngatgtcaaagcggcccnaccccatnctgntntctggtcccaagatngancatacatgaccccttntnccatgnaagggaatggttgactgggtcnggtcacaattcttaaacttggtcattngntaaaggaacgacnanccttaggtttnaaanannc

SEQ ID NO: 1072 - DNA, 286 bp, Zea mays
  unsure (1)..(286): unsure at all n locations
aaccccatgaccgttttctggtcgaagaggtcacagagcatgacgtctcgcccaatgaaggggatgctgactggcccagtcacaatcctcaactggtccttcgtccggaatgaccagccgaggtttgagacttgctaccagntcgctcttgcgatcaagaaggaagtcgaggatcttgaggctggtggtattcaggttatccaaatcgacgaggctgcactgagagaagggctgccgctccgcaangctgagcatgcattctacttggactgggctgtccactcct

SEQ ID NO: 1073 - DNA, 305 bp, Zea mays
gaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagacggcacagagcatgacgtctcgcccaatgaaggggatgctgactggcccagtcacaatcctcaactggtcttcgtccggaatgaccagccgaggtttgagattgct

SEQ ID NO: 1074 - DNA, 291 bp, Zea mays
  unsure (1)..(291): unsure at all n locations
caatcggttcgttcccacaaaccgttgagctcaggagggtccgccgngagtacaaggcaaaaaagatctctgaggaggaatacgtcactgccatcaaggaggaaatcaacaaggtcgttaagcttcaagaagagcttgacattgatgtgcttgtgcatggcgagcctgagagaaacgatatggttgagtacttcggtgagcagctctccggttttgcgttcactgccaatggctgggtgcagtcttatgggtcaaggngcgncaagcctccgatcatngagggtgaccncc

SEQ ID NO: 1075 - DNA, 297 bp, Zea mays
  unsure (1)..(297): unsure at all n locations
tgcacttgagnctttctgggatgggaagagcaccgctgaggatctggagaaggttgctaccgacctcagggccagtatctggaagcagatggctgangctgggatcaagtacatccccagcaacactttctcgtactatgaccaggtccttgacaccactgccatgctcggcgctgtccccgaacgttactcatggactggaggagagattggatttgacacctacttctccnnggccaggggcaacgccactgttcctgctatggagatgaccangtggtttgacaccaataccac

SEQ ID NO: 1076 - DNA, 312 bp, Zea mays
acctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacaccttctcgtactatgaccaggtccttgacaccactgccatgctcggcgctgtccccgaacgctactcatggactggaggaga

SEQ ID NO: 1077 - DNA, 307 bp, Zea mays
  unsure (1)..(307): unsure at all n locations
gttgggaaggacaagcttgtcgtatcaacttcctgctcgctcatgcacaccgctgtggatcttgtgaacgagactaagcttgacagcgagattaagtcttggcttgcttttgctgcccagaaggttgttgagggtgangctcttgctaaggcantggctggtcaaaaggatgaggcttacttcgcagcaaatgctgctgctcaggcctcgaggaaatcctcaccccgtgtgaccaatgaagaagtccagaaggctgctgctgctctcaagggctctgaccaccgccgtgggaccaacgttagtgcta

SEQ ID NO: 1078 - DNA, 274 bp, Zea mays
  unsure (1)..(274): unsure at all n locations
ggcgtcccacattgttggataccctcgcatgggccccaaganggagctcaagtttgcacttgagtctttctgggatgggaagaacaccgctgagnatctggagaaggttgctaccgacctcagggccagtatctggaagcagatggctgatgctgggatcaagtacatccccagcaacactttctcgtactatgaccaggtccttgacaccactgccatgctcagcgctgtccccgaacgttactcatggactggaggagagattggatttgac

SEQ ID NO: 1079 - DNA, 289 bp, Zea mays
gagagattggatttgacacctacttctccatggccaggggcaacgccactgttcctgctatggagatgaccaagtggtttgacaccaactaccactttattgtccctgaattgggcccaaacaccaagttctcctatgcttctcacaaggctgttaacgaatataaggaggctaaggcgctcggtgttgataccgtgccagtacttgttggaccagtctcgtacctgttgctctcaaagcctgccaagggtgtggagaagggattccctcttctttcccttcttagcag

SEQ ID NO: 1080 - DNA, 286 bp, Zea mays
ctaagcttgacagcgagattaagtcttggcttgcttttgctgcccagaaggttgttgaggttgatgctcttgctaaggcattggctggtcaaaaggatgaggcttacttcgcagcaaatgctgcagctcaggcctcgaggaaatcctcaccccgtgtgaccaatgaagaagtccagaaggctgctgctgctctcaagggctctgaccaccgccgtgcgaccaacgttagtgctagattggatgcccagcagaagaagcttaacctccccatccttcccaccactac

SEQ ID NO: 1081 - DNA, 323 bp, Zea mays
  unsure (1)..(323): unsure at all n locations
cgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacaccttctcgtactatgaccaggtccttgacaccactgccangctcggcgctgtccccgaacgntactcatggactggnnggagaaattgggtttcacacctat

SEQ ID NO: 1082 - DNA, 305 bp, Zea mays
cacaaaccgttgcagctcaggagggtccgccgtgagtacaaggcaaaaaagatctctgaggaggaatacgtcactgccatcaaggaggaaatcaacaaggtcgttaagctccaagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgactgagccgccccaaccccatgaccgttttctgg

SEQ ID NO: 1083 - DNA, 281 bp, Zea mays
  unsure (1)..(281): unsure at all n locations
gtacaaggcaaaaaatatctctgaggaggaatacgtcactgccatcaaggaggaaatcaacaaggtcgttaagcnccaagaagagcttgacattgangtgcttgtgcatggcgagcctgaganaaacgatatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgnagacgg

SEQ ID NO: 1084 - DNA, 314 bp, Zea mays
  unsure (1)..(314): unsure at all n locations
gaccagccgaggtttgagacttgctaccagatcgctcttgcgatcaagaaggaagtcgaggatctcgaggctggtggtattcaggttatccaaatcgacgaggctgcactgagagaagggctgccgctccgcaaggctgagcatgcattctacttggacngggctgtccacnccttcagaatcaccaacngcgagatccaggacaccacccagatccacacccacatgtgctacnccaacttcaacgacatcatccactcgatcatcgacatggacgcggngtgatcaccacgaganncnggtcgcgagaactg

SEQ ID NO: 1085 - DNA, 281 bp, Zea mays
gtgtgaccaatgaagaagtccagaaggctgctgctgctctcaagggctctgaccaccgccgtgggaccaacgttagtgctagattggatgcccagcagaagaagcttaacctccccatccttcccaccactacaatcggttcgttcccacaaaccgttgagctcaggagggtccgccgtgagtacaaggcaaaaaagatctctgaggaggaatacgtcactgccatcaaggaggaaatcaacaaggtcgttaagcttcaagaagagcttgacattgatgtg

SEQ ID NO: 1086 - DNA, 306 bp, Zea mays
ctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacaccttctcgtactatgaccaggtccttgacaccactgccatgctcggcgctgtccccgaacgctactcatggactggag

SEQ ID NO: 1087 - DNA, 265 bp, Zea mays
tgctggtattcaggtgatccagatcgatgaggcagctctaagggagggtctgccactacgcaagtcagagcatgcattctacctggactgggctgtccactctttcaggatcaccaactgcggagtccaggacaccacccagatccacacccacatgtgctactccaacttcaacgacatcatccactccatcatcgacatggatgccgatgtgatcacgatcgagaactcccggtctgacgagaagctactgtccgtcttccgt

SEQ ID NO: 1088 - DNA, 266 bp, Zea mays
gcttaacctccccatccttcccaccactacaatcggttcgttcccacaaaccgttgagctcaggagggtccgccgtgagtacaaggcaaaaaagatctctgaggaggaatacgtcactgccatcaaggaggaaatcaacaaggtcgttaagcttcaagaagagcttgacattgatgtgcttgtgcatggcgagcctgagagaaacgatatggttgagtacttcggtgagcagctctccggttttgcgttcactgccaatggctggg

SEQ ID NO: 1089 - DNA, 311 bp, Zea mays
agcagctctccggttttgcgttcactgccaatggctgggtgcagtcttatgggtcaaggtgcgtcaagcctccgatcatctacggtgacgtgagccgccccaaccccatgaccgttttctggtcgaagacggcacagagcatgacgtctcgcccaatgaaggggatgctgactggcccagtcacaatcctcaactggtccttcgtccggaatgaccagccgaggtttgagacttgctaccagatcgctcttgcgatcaagaaggaagtcgaggatttgaggctggtggtattcaggttatccaaatcgacg

SEQ ID NO: 1090 - DNA, 309 bp, Zea mays
  unsure (1)..(309): unsure at all n locations
tatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacaccttctcgtactatgaccaggtccttgacaccactgccatgctcggcgctgtccccgaacgctantcatggactggaggaga

SEQ ID NO: 1091 - DNA, 291 bp, Zea mays
cgatcatcgacatggacgcggacgtgatcaccatcgagaactcgcggtccgacgagaagctgctctccgtgttccgtgagggtgtcaagtacggcgcgggcatcggccccggtgtctacgacatccactcccccaggatcccgtcggccgaggagatcgccgaccgcatcgacaagatgctggccgtgctggacaccaacatcctctgggtgaaccccgactgcggcctcaagacccgcaagtacacggaggtcaagcccgccctgaccaacatggtctccgctgctaagt

SEQ ID NO: 1092 - DNA, 295 bp, Zea mays
  unsure (1)..(295): unsure at all n locations
tccgccgtgagtacaaggcaaaaaagatctctgaggaggaatacgtcactgccatcaaggaggaaatcaacaaggtcgtnccagcttcaagaancagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagaggcac

SEQ ID NO: 1093 - DNA, 285 bp, Zea mays
ggtgcgtcaagcctccgatcatctacggtgacgtgagccgccccaaccccatgaccgttttctggtcgaagaggcgcagagcatgacgtctcgcccaatgaaggggatgctgactggcccagtcacaatcctcaactggtccttcgtccggaatgaccagccgaggtttgagacttgctaccagatcgctcttgcgatcaagaaggaagtcgaggatctcgaggctggtggtattcaggttatccaaatcgacgaggctgcactgagagaagggctgccgctccg

SEQ ID NO: 1094 - DNA, 266 bp, Zea mays
  unsure (1)..(266): unsure at all n locations
gctgcactgagagaagggctgccgctccgcaaggntgagcatgcattctacttggactgggntgtccactccttcagaattnccaactgcgagatccaggacaccncccagatccacacccacatgtgctactccaacttcaacgacatcatccactcgatcatcgacatggacgcggacgtgatcaccattgagaactcgcggtccgacganaagctgctctccgtgttccgcgagggcgtcaagtacggcgcgggcatcggccc

SEQ ID NO: 1095 - DNA, 327 bp, Zea mays
  unsure (1)..(327): unsure at all n locations
gctgactggcccagtcacaatcctcaactggtccttcgtccggaatgaccagccgaggtttgagacttgctaccagatcgctcttgcgatcaagaaggaagtcgaggatcttgaggctggtggtattcaggttatccaaatcgacgaggctgcactgagagaagggctgccgctccgcaaggctgagcatgcattctacttggactgggctgtccactccttcagaattaccaactgcgagatccaggacaccacccagatccacacccacatgtgctatccaattcacgacatcatccatcgatcatcgncatggngcggcgtgat

SEQ ID NO: 1096 - DNA, 259 bp, Zea mays
  unsure (1)..(259): unsure at all n locations
cagnacncacccagatccacacccacatgtgctactccaacttcaacgacatcatccactccatcatcgacatggatgccgatgtgatcacgatcgagaactcccggtctgacgagaagctactgtccgtcttccgtgagggtgtgaagtacggagctggcattggccctggtgtctacgacatccactctcctaggattccctccaccgaggagatcgcagaccgcgtcgagaagatgctcgcngtgtngananaant

SEQ ID NO: 1097 - DNA, 280 bp, Zea mays
  unsure (1)..(280): unsure at all n locations
cgacgagaagctactgtccgtgttccgcganggtgtgaagtacggagctggaatcggtccaggtgtctacgacatccactcgcccaggatcccctccaccgaggagatcgcggaccgcgtcaacaagatgctcgccgtgctcgacaccaacatcctctgggtgaaccctgactgcggtctcaagacacgcaagtacacggaggtgaagcctgccctgaccaacatggtctccgccaccaagctcatccgcacccagctcggcagcgcgaaatgagtcaga

SEQ ID NO: 1098 - DNA, 303 bp, Zea mays
gcgtcctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtccttgacaccactgccatgctcggcgctgtccccgaacgt

SEQ ID NO: 1099 - DNA, 305 bp, Zea mays
cctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtccttgacaccactgccatgctcggcgctgtccccgaacgttactcatgg

SEQ ID NO: 1100 - DNA, 303 bp, Zea mays
  unsure (1)..(303): unsure at all n locations
cngacgntggncgccgctgcgccgtctcctccgctcccgtcgtccggaaagatggcgtcccacattgttggantaccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggggcaacgccactgttcctgctatggagatgaccaagtggtttgacacca

SEQ ID NO: 1101 - DNA, 288 bp, Zea mays
aggtgcgtcaagcctccgatcatctacggtgacgtgagccgccccaaccccatgaccgttttctggtcgaagaggcacagagcatgacgtctcgcccaatgaaggggatgctgactggcccagtcacaatcctcaactggtccttcgtccggaatgaccagccgaggtttgagacttgctaccagatcgctcttgcgatcaagaaggaagtcgaggatcttgaggctggtggtattcaggttatccaaatcgacgaggctgcactgagagaagggctgccgctccgca

SEQ ID NO: 1102 - DNA, 275 bp, Zea mays
  unsure (1)..(275): unsure at all n locations
cccacatgtgctactccaacttcaacgacatcatccactcgatcatcgnccatggacgcggacgtgatcaccatcgagaactcgcggtccgacgagaagctgctctccgtgttccgtgagggtgtcaagtacggcgcgggcatcggccccggtgtctacgacatccactcccccaggatcccgtcggccgaggagatcgccgaccgcatcgacaagatgctggccgtgctggacaccaacatcctctgggtgaaccccgactgcggcctcaagac

SEQ ID NO: 1103 - DNA, 319 bp, Zea mays
gtgagccgccccaaccccatgaccgttttctggtcgaagacgggcgcagagcatgacgtctcgcccaatgaaggggatgctgactggcccagtcacaatcctcaactggtccttcgtccggaacgaccagccgaggtttgagacttgctaccagatcgctcttgcgatcaagaaggaagtcgaggatcttgaggctggtggtattcaggttatccaaatcgacgaggctgcactgagagaagggctgccgctccgcaaggctgagcatgcattctacttggatgggctgtccatccttcagaataccaactgcgagatc

SEQ ID NO: 1104 - DNA, 277 bp, Zea mays
  unsure (1)..(277): unsure at all n locations
ctcttgctaaggcattggctggtcaaaaggatgaggcttacttcgcagcaaatgctgctgctcaggcctcgaggaaatcctcaccccgtgtgaccaatgaagaagtccagaaggctgctgctgctctcaagggctctgaccaccgccgtgggaccaacgttagtgctagattggatgcccagcagaagaagcttaacctccccatccttcccaccactacaatcggttcgttcccacaaaccgttgagctcaggagggtccgccgtgagtacaangc

SEQ ID NO: 1105 - DNA, 308 bp, Zea mays
  unsure (1)..(308): unsure at all n locations
caagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgangcnnaccgccccaaccccatgaccgttttctggtcgaagacggcacagagcatgacgtctcgcccaatgaaggggatgctgactggcccagtcacaatcctcaatggtccttcgtccggaatgaccanccgangtttgagattnct

SEQ ID NO: 1106 - DNA, 313 bp, Zea mays
ggaggctaaggcgctcggtgttgataccgtgccagtacttgttggaccagtctcgtacctgttgctctcaaagcccgccaagggtgtggagaagggattccctcttctttcccttcttagcagcatcctcccagtctacaaggaggtcattgctgagttgaaggcagctggggcttcatggattcagtttgatgagcccactcttgtcctcgaccttgattctgacaaattggctgcattctctgctgcatacgcagaacttgaatctgtactttctggattgaatgtgcttgttgagacttactttgctgat

SEQ ID NO: 1107 - DNA, 279 bp, Zea mays
gatgaggcttacttcgcagcaaatgctgcagctcaggcctcgaggaaatcctcaccccgtgtgaccaatgaagaagtccagaaggctgctgctgctctcaagggctctgaccaccgccgtgcgaccaacgttagtgctagattggatgcccagcagaagaagcttaacctccccatccttcccaccactacaatcggttcgttcccacaaaccgttgagctcaggagggtccgccgtgagtacaaggcaaaaaagatctctgaggaggaatacgtcact

SEQ ID NO: 1108 - DNA, 264 bp, Zea mays
aaacgaggaggtccaaaaggctgcagctgctttgaagggttctgaccaccgccgtgctaccactgttgctgctagattggatgctcagcagaaaaagctcaaccttcctgtccttcccacaaccacaattggttcattccctcagactgtggaactcaggagggtccgtcgtgagtacaaggcaaagaagatctccgaggaggaatacatcagtgccatcaaggaagaaatcagcaaggttgtcaagatccaagaggagcttga

SEQ ID NO: 1109 - DNA, 275 bp, Zea mays
ggttgatgctcttgctaaggcattggctggtcaaaaggatgaggcttacttcgcagcaaatgctgctgctcaggcctcgaggaaatcctcaccccgtgtgaccaatgaagaagtccagaaggctgctgctgctctcaagggctctgaccaccgccgtgggaccaacgttagtgctagattggatgcccagcagaagaagcttaacctccccatccttcccaccactacaatcggttcgttcccacaaaccgttgagctcaggagggtccgccgtg

SEQ ID NO: 1110 - DNA, 278 bp, Zea mays
ctcatggactggaggagagattggatttgacacctacttctccatggccaggggcaacgccactgttcctgctatggagatgaccaagtggtttgacaccaactaccactttattgtccctgaattgggcccaaacaccaagttctcctatgcttctcacaaggctgttaacgaatataaggaggctaaggcgctcggtgttgataccgtgccagtacttgttggaccagtctcgtacctgttgctctcaaagcctgccaagggtgtggagaagggat

SEQ ID NO: 1111 - DNA, 310 bp, Zea mays
  unsure (1)..(310): unsure at all n locations
cacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacaccttctcgtactatgaccaggtccttgacaccactgccatgctcggcgctgtccccanaacgctactcatggactggag

SEQ ID NO: 1112 - DNA, 265 bp, Zea mays
gtcactgccatcaaggaggaaatcaacaaggtcgttaagctccaagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagacggcgcagagcatgacgtctc

SEQ ID NO: 1113 - DNA, 305 bp, Zea mays
cgacgagaagctactgtccgtgttccgcgagggtgtgaagtacggagctggaatcggtccaggtgtctacgacatccacttcgcccaggatcccctccaccgaggagatcgcggaccgcgtcaacaagatgctcgccgtgctcgacaccaacatcctctgggtgaaccctgactgcggtctcaagacacgcaagtacacggaggtgaagcctgccctgaccaacatggtctccgccaccaagctcatccgcacccagctcggcagcgcgaaatgagtcagatttggtagatccatggtttgttga

SEQ ID NO: 1114 - DNA, 310 bp, Zea mays
  unsure (1)..(310): unsure at all n locations
gtggtttgacaccaactaccactttattgtccctgaattgggcccaaacaccaagttctcctatgcttctcacaaggctgttaacgaatataaggaggctaaggcgctcggtgttgataccgtgccagtacttgttggaccagtctcgtacctgttgctctcaaagcctgccaagggtgtggagaagggattccctcttctttcccttcttagcagnacttcccagtctacaaggaggtcattgctgagttgaaggcagctggggcttcaggattcagtttgatgagcccatcttgtcctcgactngatt

SEQ ID NO: 1115 - DNA, 331 bp, Zea mays
  unsure (1)..(331): unsure at all n locations
taagcttcaagaagagcttgacattgatgtgcttgngcatggcgagcctganagaaacgatatggttgagtacttcggtgagcagctctccggttttgcgttcactgccaatggcngggtgcagtcttatgggtcaaggtgcgtcaagcctccgatcatctacggtgacgtgagccgccccaaccccatgaccgttttctggtcgaagacgggcacagagcatgacgtctcgcccaatgaangggatgctgactggcccagtcacaatcctcnactggtcttcgtccggaatgaccagccgangttgagattgctacnagatcgctcttgc

SEQ ID NO: 1116 - DNA, 279 bp, Zea mays
aacaaggtcgttaagcttcaagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagaggcacagagcatgacgtctcgcccaatgaaggggatgctgactggcccagtcacaatcc

SEQ ID NO: 1117 - DNA, 292 bp, Zea mays
atcgccgctgcgccgtctcctccgctcccgtcgtccggaaagatggcgtcccacattgttggataccctcgcatggggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtccttgacaccactgccatgctcggcgctgtccccgaacgttactca

SEQ ID NO: 1118 - DNA, 270 bp, Zea mays
gaggaaatcaacaaggtcgttaagctccaagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagaggcgcagagcatgacgtctcgcccaatgaaggggatgctga

SEQ ID NO: 1119 - DNA, 252 bp, Zea mays
  unsure (1)..(252): unsure at all n locations
cagcagaagaagcttaacctacccatccttccncccactacaataggttcgttcccacaaaccgttgagctcaggagggtccgccgtgagtacaaggcaaaaaagatctctgaggaggaatacgtcactgccatcaaggaggaaatcaacaaggtcgttaagctccaagaagagcttgacattgatgtgcttgtgcatggcgagcctgagagaaacgatatggttgagtacttcggtgagcagctctccggt

SEQ ID NO: 1120 - DNA, 284 bp, Zea mays
cgttttctggtcgaagaggcacagagcatgacgtctcgcccaatgaaggggatgctgactggcccagtcacaatcctcaactggtccttcgtccggaatgaccagccgaggtttgagacttgctaccagatcgctcttgcgatcaagaaggaagtcgaggatcttgaggctggtggtattcaggttatccaaatcgacgaggctgcactgagagaagggctgccgctccgcaaggctgagcatgcattctacttggactgggctgtccactccttcagaattac

SEQ ID NO: 1121 - DNA, 287 bp, Zea mays
cgctcatgcacaccgctgtggatcttgtgaacgagactaagcttgacagcgagattaagtcttggcttgcttttgctgcccagaaggttgttgaggttgatgctcttgctaaggcattggctggtcaaaaggatgaggcttacttcgcagcaaatgctgctgctcaggcctcgaggaaatcctcaccccgtgtgaccaatgaagaagtccagaaggctgctgctgctctcaagggctctgaccaccgccgtgggaccaacgttagtgctagattggatgcccagcag

SEQ ID NO: 1122 - DNA, 290 bp, Zea mays
  unsure (1)..(290): unsure at all n locations
cggacntggnccgctgtggatcttgtgaacgagactaagcttgacagcgagattaagtcttggcttgcttttgctgcccagaaggttgttgaggttgatgctcttgctaaggcattggctggtcaaaaggatgaggcttacttcgcagcaaatgctgcagctcaggcctcgaggaaatcctcaccccgtgtgaccaatgaagaagtccagaaggctgctgctgctctcaagggctctgaccaccgccgtgcgaccaacgttagtgctagattggatgcccagcagaagaa

SEQ ID NO: 1123 - DNA, 344 bp, Zea mays
  unsure (1)..(344): unsure at all n locations
cgtcactgccatcaaggaggnaatcaacaaggtcgttaagcttcaagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcancnacggtgacgtgagccgccccaaccccatgaccgttttctggtcgaagacggcacagagcatgacgtctcgcccatgangggatgctgctggcccatcacaancctcaatngtccttcgtccggatgaccagcgagttgagnttctac

SEQ ID NO: 1124 - DNA, 261 bp, Zea mays
  unsure (1)..(261): unsure at all n locations
cgtcactgccatcaaggaggaaatcaacaaggtcgttaagctcnaagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagacggcgcaaagcatgac

SEQ ID NO: 1125 - DNA, 301 bp, Zea mays
  unsure (1)..(301): unsure at all n locations
gcacgcgtgggcgacatggacgcggacgtgatcaccattgagaactcgcggtccgacgagaagctgctctccgtgttccganngggcgtcaaacncggcgcgggcatcggccccggtgtctacgacatccactcccccaggatcccgtcggctgaggagatcgccgaccgcatcgacaagatgctggcggtgctggacaccaacatcctctgggtgaaccccgactgcggcctcaagacccgcaagtacacggaggtcaagcccgccctgaccaacatggtctccgccgctaagctcatcc

SEQ ID NO: 1126 - DNA, 264 bp, Zea mays
  unsure (1)..(264): unsure at all n locations
gggctgtccactccttcagaattaccaactgcnagatccaggacaccacccagatccacacccacatgtgctactccaacttcaacgncatcatccactcgatcatcgacatggacgcggacgtgntcaccattgagaactcgcggtccgacgagaagctgctctccgtgttccgcgagggcgtcaagtacggcgcgggcatcggccccggtgtctacgacatccnctcccccaggatcccgtcggctgaggagatcgccgacc

SEQ ID NO: 1127 - DNA, 277 bp, Zea mays
atcatccactcgatcatcgacatggacgcggacgtgatcaccattgagaactcgcggtccgacgagaagctgctctccgtgttccgcgagggcgtcaagtacggcgcgggcatcggccccggtgtctacgacatccactcccccaggatcccgtcggctgaggagatcgccgaccgcatcgacaagatgctggcggtgctggacaccaacatcctctgggtgaaccccgactgcggcctcaagacccgcaagtacacggaggtcaagcccgcctgac

SEQ ID NO: 1128 - DNA, 246 bp, Zea mays
gggctgtccactctttcaggatcaccaactgcggagtccaggacaccacccagatccacacccacatgtgctactccaacttcaacggacatcatccactccatcatcgacatggatgccgatgtgatcacgatcgagaactcccgatctgacgagaagctactgtccgtcttccgtgagggtgtgaagtacggagctggcattggccctggtgtctacgacatccactctcctaggattccctcc

SEQ ID NO: 1129 - DNA, 270 bp, Zea mays
aaatcaacaaggtcgttaagctccaagaagagcttgacattgatgtgcttgtgcatggcgagcctgagagaaacgctatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagaggcgcagagcatgacgtctcgcccaatgaaggggatgctgactgg

SEQ ID NO: 1130 - DNA, 492 bp, Zea mays
  unsure (1)..(492): unsure at all n locations
ttannttccgcgccagtaaggtaagaattcccgggncgacccacgcgtcagtgagaactcgcggtccgacgagaagctgctctccgtgttccgcgagggcgtcaagtacggcgcgggcatcggccccggtgtctacgacatccactcccccaggatcccgtcggctgaggagatcgccgaccgcatcgacaagatgctggcggtgctggacaccaacatcctctgggtgaaccccgactgcggcctcaagacccgcaagtacacggaggtcaagcccgccctgaccaacatggtctccgccgctaaagctcatccgcacccagctcgccagcgccaagtgagcaccttttttttgcctttttcgtttccgaaganggcgtcntcgatgccaatttgtttccaataaacanggctgtnncccgccgttccggttgtnanccgttcggtggtaaggttannaattttcctgaatttccccccaanggcggttng

SEQ ID NO: 1131 - DNA, 250 bp, Zea mays
  unsure (1)..(250): unsure at all n locations
aactcaggagggttcgccgtgaatacaaggcnaagaagatcaccgaggacgaatacatcagtgccatcaaggaagaaatcagcaaggttgtcaagatccaagaggagcttgacattgatgtgcttgtgcatggagagccagagagaaatgacatggttgagtacttcggtgncnaattatctggttttgcgttcactgccaacggatgggtgcaatcctatggatcacgctgtgtgaagccacccattat

SEQ ID NO: 1132 - DNA, 262 bp, Zea mays
tcttggcttgcttttgctgcccagaaggttgttgaggttgatgctcttgctaaggcattggctggtcaaaaggatgaggcttacttcgcagcaaatgctgctgctcaggcctcgaggaaatcctcaccccgtgtgaccaatgaagaagtccagaaggctgctgctgctctcaagggctctgaccaccgccgtgggaccaacgttagtgctagattggatgcccagcagaagaagcttaacctccccatccttcccaccacta

SEQ ID NO: 1133 - DNA, 269 bp, Zea mays
  unsure (1)..(269): unsure at all n locations
gctgctcaggcctcgaggaaatcctcaccccgtgtgaccaatgaagaagtccagaaggctgctgctgctctcaagggctctgaccaccgccgtgcgaccaacgttagtgctagattggatgcccagcagaagaagcttaacctccccatccttcccaccactacaatcggttcgttccnacaaaccgttgagctcaggagggtccgccgtgagtacaaggcaaaaaagatctctgaggaggaatacgtcactgccatcaaggaggaaat

SEQ ID NO: 1134 - DNA, 269 bp, Zea mays
cgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacaccttctcgtactatgaccaggtccttgacaccactgccatgctcggcg

SEQ ID NO: 1135 - DNA, 299 bp, Zea mays
  unsure (1)..(299): unsure at all n locations
gcgatcaagaaggaagtcgaggatcttgaggctggtggtattcaggttatccaaatcgacgaggctgcactgagagaagggctgccgntccgcaaggctgagcatgcattctacttggactgggctgtccactccttcagaattaccaactgcgagatccaggacaccacccagatccacacccacatgtgctantccaacttcaacgacatcatccactcgatcatcgacatggacgnggacgtgatnaccattgagaantcgggtccgangggnagctgctctcngtgttcngggag

SEQ ID NO: 1136 - DNA, 276 bp, Zea mays
ctcaccccgtgtgaccaatgaagaagtccagaaggctgctgctgctctcaagggctctgaccaccgccgtgggaccaacgttagtgctagattggatgcccagcagaagaagcttaacctccccatccttcccaccactacaatcggttcgttcccacaaaccgttgagctcaggagggtccgccgtgagtacaaggcaaaaaagatctctgaggaggaatacgtcactgccatcaaggaggaaatcaacaaggtcgttaagcttcaagaagagct

SEQ ID NO: 1137 - DNA, 257 bp, Zea mays
ccaactgcgagatccaggacaccacccagatccacacccacatgtgctactccaacttcaacgacatcatccactcgatcatcgacatggacgcggacgtgatcaccatcgagaactcgcggtccgacgagaagctgctctccgtgttccgtgagggtgtcaagtacggcgcgggcatcggccccggtgtctacgacatccactcccccaggatcccgtcggccgaggagatcgccgaccgcatcgacaagatgctg

SEQ ID NO: 1138 - DNA, 275 bp, Zea mays
gcttacttcgcagcaaatgctgctgctcaggcctcgaggaaatcctcaccccgtgtgaccaatgaagaagtccagaaggctgctgctgctctcaagggctctgaccaccgccgtgggaccaacgttagtgctagattggatgcccagcagaagaagcttaacctccccatccttcccaccactacaatcggttcgttcccacaaaccgttgagctcaggagggtccgccgtgagtacaaggcaaaaaagatctctgaggaggaatacgtcactgc

SEQ ID NO: 1139 - DNA, 295 bp, Zea mays
agatggcacagagcatgacccctcgtcccatgaagggaatgttgactggtccggtcacaatcctgaactggtcattcgtcaggaacgaccagcctaggtttgagacatgctaccaaatagctcttgcaatcaaaaaggaggttgaggatcttgaggctgctggtattcaggtgatccagatcgatgaggcagctctaagggagggtctgccactacgcaagtcagagcatgcattctacctggactgggctgtccactctttcaggatcaccaactgcggagtccaggacaccac

SEQ ID NO: 1140 - DNA, 316 bp, Zea mays
gcattctctgctgcatacgcagaacttgaatctgtactttctggattgaatgtgcttgttgagacttactttgctgatgttcctgctgagtcctacaagaccctaacatccctgagcagtgtgactgcttatggttttgatcttgtccgtggaacccaaactcttgggcttgtcacgagtgctggtttccctgctggaaagtacctctttgctggtgttgtggatggacgcaacatctgggctgatgatcttgctacatctctcagcactctccagtctcttgaggctgttgttgggaaggacaagcttgtcgtat

SEQ ID NO: 1141 - DNA, 445 bp, Zea mays
  unsure (1)..(445): unsure at all n locations
ccactcttgtcctcgaccttgattctgacaaattggctgcattctctgctgcatacgcagaacttgaatctgtactttctggattgaatgtgcttgttgagacttactttgctgatgttcctgctgagtcctacaagaccctaacatctctgagcagtgtgactgcctatggttttgatcttgtccgtggaacccaaactcttgggcttgtcacgagtgctggtttccctgctggaaagtacctctttgctggtgttgtggatggacgcaacatctgggctgatgatcttgctacatctctaacactcttcagtctcttgaggctgttgttgggaangacaagcttgtcgatcaacttnctgctcgctcatgcacaccgntgtggatcttgngaaccagactnagcttgacagcagatnaatctggcttgctttgctgccanaag

SEQ ID NO: 1142 - DNA, 301 bp, Zea mays
gccaagacggttgttgaggttgatgctcttgctaaggcattggctggtcaaaaggatgaggcttacttcgcagcaaatgctgcagctcaggcctcgaggaaatcctcaccccgtgtgaccaatgaagaagtccagaaggctgctgctgctctcaagggctctgaccaccgccgtgcgaccaacgttagtgctagattggatgcccagcagaagaagcttaacctccccatcttcccaccatacaatcggttcgttcccacaaaccgttgagctcaggagggtccgccgtgagtacaaggca

SEQ ID NO: 1143 - DNA, 277 bp, Zea mays
  unsure (1)..(277): unsure at all n locations
gtggtattcaggttatccaaatcgacgaggctgcactgagagaagggctgccgctccgcaaggctgagcatgcattctacttggactgggctgtccactccttcagaatcaccaactgcgagatccaggacaccacccngatccacacccacatgtgctactccaacttcaacgacatcatccactcgatcatcgacatggacgcggacgtgatcaccatcgagaatcgcggtccgacgagaagctgctctccgtgttccgtgaggtgtcaagtacg

SEQ ID NO: 1144 - DNA, 281 bp, Zea mays
  unsure (1)..(281): unsure at all n locations
cgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaangttgctaccgacctcagggccagtatctggaagcagatggctgatgctgggatcaagtacatccccagcaacactttctcgtactatgaccaggtcctttgacaccactgccatgctcggcgctgtccccgaa

SEQ ID NO: 1145 - DNA, 247 bp, Zea mays
gccgtgctaccactgttgctgctagattggatgctcagcagaaaaagctcaaccttcctgtccttcccacaaccacaattggttcattccctcagactgtggaactcaggagggtccgtcgtgagtacaaggcaaagaagatctccgaggaggaatacatcagtgccatcaaggaagaaatcagcaaggttgtcaagatccaagaggagcttgacattgatgtgcttgtgcatggagagccagagag

SEQ ID NO: 1146 - DNA, 268 bp, Zea mays
tgctgactggcccagtcacaatcctcaactggtccttcgtccggaatgaccagccgaggtttgagacttgctaccagatcgctcttgcgatcaagaaggaagtcgaggatcttgaggctggtggtattcaggttatccaaatcgacgaggctgcactgagagaagggctgccgctccgcaaggctgagcatgcattctacttggactgggctgtccactccttcagaattaccaactgcgagatccaggacaccacccagatccacac

SEQ ID NO: 1147 - DNA, 290 bp, Zea mays
  unsure (1)..(290): unsure at all n locations
cggnacggtggcnacctatcatcgccgctgcgccgtctcctccgctcccgtcgtccggaaagatggcgtcccacattgttggataccctcgnntgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtccttgacaccactgccatgctcggc

SEQ ID NO: 1148 - DNA, 269 bp, Zea mays
caaggagatcatcgcccagggtgacaaacgaggaggtccagaaggctgcagctgctttgaggggatctgaccaccgccgttctaccactgtttctgctagattggatgctcagcagaaaaagctcaaccttcctgtccttcccacaaccacaattggttcattccctcagactgtggaactcaggagggttcgccgtgaatacaaggcaaagaagatcaccgaggacgaatacatcagtgccatcaaggaagaaatcagcaaggttgtc

SEQ ID NO: 1149 - DNA, 280 bp, Zea mays
  unsure (1)..(280): unsure at all n locations
caagaagagcttgacatnnatgtncttgtncatngcgagcctgagagaaacgatatggttgagnacntcggtgagcagctcnccggttttgcgttcacngccaatggctgggtgcagtcttatgggtcaaggtgcgtcaagcctccgatcatctacggtgacgtgagcngccccaaccccatgaccgttttcnggtcgaagacngcgcagagcatgacgtctcgcccaatgaaggggatgctganggcccagtcacaatcctcaacnggtccttcgtccg

SEQ ID NO: 1150 - DNA, 323 bp, Zea mays
gagaactcgcggtccgacgagaagctgctctccgtgttccgtgagggtgtcaagtacggcgcgggcatcggccccggtgtctacgacatccactcccccaggatcccgtcggccgaggagatcgccgaccgcatcgacaagatgctggccgtgctggacaccaacatcctctgggtgaaccccgactgcggcctcaagacccgcaagtacacggaggtcaagcccgccctgaccaacatggtctccgctgctaagtcattcgcacccagctcgccagcgccaagtgagcactttttttgcctttttcgtttccgaggaggggt

SEQ ID NO: 1151 - DNA, 325 bp, Zea mays
caccacccacatctcagttcaccccggcgtcgtcctcttcccccggcgctactctcccgctccacgttccaaaggaaagatggcgtcccatattgttggataccctcgcatgggccccaagagagagctcaagtttgccttggagtctttctgggatgggaagagcagcgccgatgatttagagaaagttgcctctgacctcaggtctagcatctggaagcaaatgtcagaagctgggatcaagtacattcccagcaacaccttctcgtactatgaccaggtccttgataccacggccatgcttggtgtgtcccagagcgctact

SEQ ID NO: 1152 - DNA, 272 bp, Zea mays
  unsure (1)..(272): unsure at all n locations
ggacgtggacttcgcatgggccccaagagggagctcaagtttgcacttgagtcantctgggatgggaagagcaccgctgaggatctggagaaggttgctaccgacctcagggccagtatctggangcagatggctgatgctgggatcaagtacatccccagcaacaccttctcgtactatgaccaggtccttgacaccactgccatgctcggcgctgtccccgaacgctactcatggactggaggagagattgggtttgacacctacttctc

SEQ ID NO: 1153 - DNA, 232 bp, Zea mays
gggctgtccactccttcagaatcaccaactgcgagatccaggacaccacccagatccacacccacatgtgctactccaacttcaacgacatcatccactcgatcatcgacatggacgcggacgtgatcaccatcgagaactcgcggtccgacgagaagctgctctccgtgttccgtgagggtgtcaagtacggcgcgggcatcggccccggtgtctacgacatccactcccc

SEQ ID NO: 1154 - DNA, 285 bp, Zea mays
  unsure (1)..(285): unsure at all n locations
atcgacgaggctgcactgagagaagggctgccgctccgcaaggctgagcatgcattctacttggactgggctgtccactccttcagaatcaccaactgcgaaatccaggacaccacccagatccacacccacatgtgctactccacttcaacgacatcatccactcgattnccgacatggacgcggacgtgatcaccatcgagaactcgcggtccgacgagaagctgctctccgtgttccgtgaggtgtcaagtacggcgcgggcatcggccccggtgtctacga

SEQ ID NO: 1155 - DNA, 327 bp, Zea mays
cccggtctgacgagaagctactgtccgtcttccgtgagggtgtgaagtacggagctggcattggccctggtgtctacgacatccacttctcctaggattccctccaccgaggagatcgcagaccgcgtcgagaagatgctcgccgtgctcgacaccaacatcctctgggtgaaccctgactgtggtctcaagacacgcaagtacacggaggtcaagcccgccctgaccaacatggtctcggccaccaagctcatccgcacccagcttgccagcgcgaaatgagtcgtttgatagtccatggtctgatagcgcggaatgagccagttt

SEQ ID NO: 1156 - DNA, 284 bp, Zea mays
  unsure (1)..(284): unsure at all n locations
cgtgatcaccattgaganctcgcggtccgacgagaagctgctctccgtgttccgcgaggngcgtcaagtacggcgcgggcatcggccccggtgtctacnacatccactcccccaggatcccgtcggctgaggagatcgccgaccgcatcgacaagatgctggcggtgctggacaccaacatcctctgggtgaaccccgactgcggcctcaagacccgcaagtacacggaggtcaagcccgccctgaccaacatggtctccgccgctaagctcatccgcacccag

SEQ ID NO: 1157 - DNA, 293 bp, Zea mays
gtcttgggcttgcttttgctgcccagaaggttgttgaggttgatgctcttgctaaggcattgggctggtcaaaaggatgaggcttacttcgcagcaaatgctgctgctcaggcctcgaggaaatcctcaccccgtgtgaccaatgaagaagtccagaaggctgctgctgctctcaagggctctgaccaccgccgtgggaccaacgttagtgctagattggatgcccagcagaagaagcttaacctccccatccttcccaccactacaatcggttcgttcccacaaaccgttga

SEQ ID NO: 1158 - DNA, 309 bp, Zea mays
  unsure (1)..(309): unsure at all n locations
cgccgctgcgccgtctcctccgctcccgtcgtccggaaagatggcgncccacattgttggataccctcgcatgggccccaagagggagctcaagtttgcacttgagtctttctgggatgggaagggcaccgctgaggatctggagaaggttgctaccgacctcagggccagtatctggaagcagatggctgatgctgggatcaagtacatccccagaancactttctcgtactatgaccaagtcttgacaccatgccatgctcggcgctgtccccgaacgttactcatggactggaggagagatggatt

SEQ ID NO: 1159 - DNA, 462 bp, Zea mays
  unsure (1)..(462): unsure at all n locations
cgtgcggtgntccgcgagggcgtcaagtacggcgcnggcatcggccccggtgtctacgacntccactcccccaggatcccgtcggctgaggagatcgccgaccgcatcgacaagatgctggcggtgctggacaccaacatcctctgggtgaaccccgactgcggcctcaagacccgcaagtacacggaggtcaagcccgccctgaccaacatggtctccgccgctaagctcatccgcacccagctcgccagcgccaagtgagcaccttttttttgcctttttcgtttccgaggagggccgtcgtcgatgccaatttgtttccaataaacagggcttgtgcccgccgttctgttgtactccgtctgtggttaggttaagtagttttcttgatctcgcccccacgcggtacctgntttactactctctggttggtgggttctgaagcaaagttnnccgtttact

SEQ ID NO: 1160 - DNA, 231 bp, Zea mays
ggctgcactgagagaagggctgccgctccgcaaggctgagcatgcattctacttggactgggctgtccactccttcagaatcaccaactgcgagatccaggacaccacccagatccacacccacatgtgctactccaacttcaacgacatcatccactcgatcatcgacatggacgcggacgtgatcaccatcgagaactcgcggtccgacgagaagctgctctccgtgtt

SEQ ID NO: 1161 - DNA, 275 bp, Zea mays
  unsure (1)..(275): unsure at all n locations
gttgactggtccggtcacaatcctganctggtcattcgtcaggaacgaccagcctaggtttgagacatgctaccaaatagctcttgcaatcaaaaaggaggttgaggatcttgaggcnncnggtattcaggtgatccagatcgatgaggcagctctaagggagggtctgccactacgcaagtcagagcatgcattctacctggactgggctgtccactctttcaggatcaccaactgcggagtccaggacaccacccagatccacacccacatgt

SEQ ID NO: 1162 - DNA, 290 bp, Zea mays
  unsure (1)..(290): unsure at all n locations
gagagattggatttgacacctacttctccatggccaggggcaacgccactgttcctgctatggagatgaccaagtggtttgacaccaactaccactttantgtccctgganttgggcccaaacaccaagttctcctatgcttctcacaaggctgttaacgaatataaggaggctaaggcgctcggtgttgataccgtgccagtacttgttggaccagtctcgtacctgttgctctcaaagcctgccaagggtgtggagaagggattcnctcttctttcccttcttagcag

SEQ ID NO: 1163 - DNA, 342 bp, Zea mays
  unsure (1)..(342): unsure at all n locations
cngtgacgtgagccgccccaaccccatgaccgttttctggtcgaagacggcgcagagcatgacgtctcngccaatgaaaggngatgctgactggcccagtncacaatcctcaactggtccttcgtccggaatgaccagccgaggtttgagacttgctaccagatcgctcttgcgatcaagaaggaagtcgaggatctcgaggctggtggtattcaggttatccaaatcgacgaggctgcactgagagaagggctgccgctccgcaaggctgagcatgcatctacttggactgggctgtccatccttcagaatcaccaatgcgnagaccaggacaccacccag

SEQ ID NO: 1164 - DNA, 264 bp, Zea mays
aaccccatgaccgttttctggtcgaagaggcacagagcatgacgtctcgcccaatgaaggggatgctgactggcccagtcacaatcctcaactggtccttcgtccggaatgaccagccgaggtttgagacttgctaccagatcgctcttgcgatcaagaaggaagtcgaggatcttgaggctggtggtattcaggttatccaaatcgacgaggctgcactgagagaagggctgccgctccgcaaggctgagcatgcattctact

SEQ ID NO: 1165 - DNA, 298 bp, Zea mays
  unsure (1)..(298): unsure at all n locations
gtccagaaggctgcagctgctttgaggggatctgaccaccgccgttctaccactgtttctgctagattggatgctcagcagacaaagctcaaccttnctgtccttcccacaaccacaattgnttcattccctcagactgtggaactcaggagggttcgccgtgaatacaaggcaaagaagatcaccgaggacgaaaanatcagtgccatcaaggaagaaattcagcaaggttgtcaagatccaagaggagntgacattgatgtgcttgtgcatggagagccagagagaatgacatggt

SEQ ID NO: 1166 - DNA, 226 bp, Zea mays
gcttgacattgatgtgcttgtgcatggagagccagagagaaatgacatggttgagtacttcggtgagcaattatctggttttgcgttcactgccaacggatgggtgcaatcctatggatcacgctgtgtgaagccacccattatctacggtgatgtcagccggccgaaccccatgactgttttctggtccaagatggcacagagcatgacccctcgtcccatgaag

SEQ ID NO: 1167 - DNA, 254 bp, Zea mays
gtccggaatgaccagccgaggtttgagacttgctaccagatcgctcttgcgatcaagaaggaagtcgaggatcttgaggctggtggtattcaggttatccaaatcgacgaggctgcactgagagaagggctgccgctccgcaaggctgagcatgcattctacttggactgggctgtccactccttcagaattaccaactgcgagatccaggacaccacccagatccacacccacatgtgctactccaacttcaa

SEQ ID NO: 1168 - DNA, 251 bp, Zea mays
ctccggttttgcgttcactgccaatggctgggtgcagtcttatgggtcaaggtgcgtcaagcctccgatcatctacggtgacgtgagccgccccaaccccatgaccgttttctggtcgaagaggcgcagagcatgacgtctcgcccaatgaaggggatgctgactggcccagtcacaatcctcaactggtccttcgtccggaatgaccagccgaggtttgagacttgctaccagatcgctcttgcgatcaa

SEQ ID NO: 1169 - DNA, 279 bp, Zea mays
  unsure (1)..(279): unsure at all n locations
atcgccgctgcgccgtctcctccgctcccgtcgtncggaaagatggcgtcccacattgttggataccctcgcatgggccccaagagggagctcaagtttgcacttgagtctttctgggatgggaagagcaccgctgaggatctggagaaggttgcnacngaacttnagggccagtatctggaagcaganggctgatgctgggatcaagtacatccccagcaacactttctcgtactatgaccaggtccttgacacnactgccatgctggggctggtccc

SEQ ID NO: 1170 - DNA, 268 bp, Zea mays
  unsure (1)..(268): unsure at all n locations
atgggtcaaggtgcgtcaagcctccgatcatctacggtgacgtgagcngccccaaccccatgaccgttttctggtcgaagaggcgcagancatgacgtctcgcccaatgaaggggatgctgactggcccagtcacaatcctcaactggtccttcgtccggaatgaccagccgaggtttgagacttgctaccagatcgctcttgcgatcaagaaggaagtcgaggatctcgaggctggtggtattcaggttatccaaatcgacgaggct

SEQ ID NO: 1171 - DNA, 90 bp, Zea mays
  unsure (1)..(90): unsure at all n locations
cgtcggctgaggagatcgccgaccgcatcnacaagatgctggcggtgctggacaccaacatcntctgggtgaaccccgactgcngcctca

SEQ ID NO: 1172 - DNA, 254 bp, Zea mays
  unsure (1)..(254): unsure at all n locations
gtcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacaccttntcgtactatgaccaggtccttgacaccatgccatgctcggnt

SEQ ID NO: 1173 - DNA, 251 bp, Zea mays
  unsure (1)..(251): unsure at all n locations
caaacgaggaggtccagaaggctgcagctgctttgaggggatctgaccaccgccgttctaccactgtttctgctagattggatgctcagcagaaaaagctcaaccttcctgtccttcccacaaccacaattggttcattccctcagactgtggaactcaggagggttcgccgtgaatacaaggcaaagaagatcaccgaggacgaatacatcagtgncatcaaggaagaaatcagcaaggttgtcaagatc

SEQ ID NO: 1174 - DNA, 246 bp, Zea mays
ccgatgtgatcacgatcgagaactcccggtctgacgagaagctactgtccgtcttccgtgagggtgtgaagtacggagctggcattggccctggtgtctacgacatccactctcctaggattccctccaccgaggagatcgcagaccgcgtcgagaagatgctcgccgtgctcgacaccaacatcctctgggtgaaccctgactgtggtctcaagacacgcaagtacacggaggtcaagcccgccc

SEQ ID NO: 1175 - DNA, 258 bp, Zea mays
gaacgatcagcctaggtttgagacatgctaccaaatagctcttgcaataaaaaaggaggttgaggatcttgaggctgctggtattcaggtgatccagattgatgaggcagctctaagggagggtctgccactgcgcaagtcagagcatgcattctacctggactgggctgtccactctttcagaatcaccaactgcggagtccaggacaccacccagatccacacccatatgtgctactccaacttcaacgacatcat

SEQ ID NO: 1176 - DNA, 276 bp, Zea mays
  unsure (1)..(276): unsure at all n locations
cggacntggnnagngnaaatcctcaccccgtgtgaccaatgaagaagtccagaaggctgctgctgctctcaagggctctnaanaccgccgnngnaccaacgttagtgctagattggatgcccagcagaagaagcttaacctccccatccttcccaccactacaatcggttcgttcccacaaaccgttgagctcaggagggtccgccgtgagtacaaggcaaaaaagatctctgaggaggaatacgtcactgccatcaaggaggaaatcaacaaggt

SEQ ID NO: 1177 - DNA, 297 bp, Zea mays
acgagtgctggtttccctgctggaaagtacctctttgctggtgttgtggatggacgcaacatctgggctgatgatcttgctacatctctcagcactctccagtctcttgaggctgttgttgggaaggacaagcttgtcgtatcaacttcctgctcgctcatgcacaccgctgtggatcttgtgaacgagactaagcttgacagcgagattaagtcttggcttgctttttgcccagaaggttgttgaggttgatgctcttgctaaggcattggctgggccaaaagatgagcttacttc

SEQ ID NO: 1178 - DNA, 283 bp, Zea mays
ggaggctaaggcgctcggtgttgataccgtgccagtacttgttggaccagtctcgtacctgttgctctcaaagcctgccaagggtgtggagaagggattccctcttctttcccttcttagcagcatcctcccagtctacaaggaggtcattgctgagttgaaggcagctggggcttcatggattcagtttgatgagcccactcttgtcctcgaccttgattctgacaaattggctgcattctctgctgcatacgcagaacttgaatctgtactttctggattg

SEQ ID NO: 1179 - DNA, 84 bp, Zea mays
  unsure (1)..(84): unsure at all n locations
ancttctngtactatgaccaggtccttganaccagtnccatgctcggcgctgtccccgaacgctaccatggactggacgagaga

SEQ ID NO: 1180 - DNA, 315 bp, Zea mays
  unsure (1)..(315): unsure at all n locations
gtttgatgagcccactcttgtcctcgaccttgattctgacaaattggctgcattctctgctgcatacgcagaacttgaatctgtactttctggattgaatgtgcttgttgagacttactttgctgatgttcctgctgagtcctacaagnccctaacatccctgagcagtgtgactgcttatggttttgatcttgtccgtggaacccaaactcttgggcttgtcacgagtgctggtttccctgctggaaagtacctctttgctggtgttgtggatggacgcaacatctgggctgatgatcttgctacatctctcag

SEQ ID NO: 1181 - DNA, 267 bp, Zea mays
agccgccccaaccccatgaccgttttctggtcgaagaggcgcagagcatgacgtctcgcccaatgaaggggatgctgactggcccagtcacaatcctcaactggtccttcgtccggaatgaccagccgaggtttgagacttgctaccagatcgctcttgcgatcaagaaggaagtcgaggatctcgaggctggtggtattcaggttatccaaatcgacgaggctgcactgagagaagggctgccgtccgcaaggctgagcatgcatt

SEQ ID NO: 1182 - DNA, 249 bp, Zea mays
tgtgaagtacggagctggcattggccctggtgtctacgacatccactctcctaggattccctccacagaggagatcgcagaccgcgtcgagaagatgctcgccgtgctcgacaccaacatcctctgggtgaaccctgactgtggtctcaagacacgcaagtacacggaggtcaagcccgccctgaccaacatggtctcggccaccaagctcatccgcacccagcttgccagcgcgaaatgaggtcgttt

SEQ ID NO: 1183 - DNA, 259 bp, Zea mays
  unsure (1)..(259): unsure at all n locations
ctcacctatcatcgccgctgcgccgtctcctccgctcccgtcgtccggaaagatggcgtcccacattgttggataccctcgcatgggccccaagagggngctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtcctt

SEQ ID NO: 1184 - DNA, 296 bp, Zea mays
  unsure (1)..(296): unsure at all n locations
ctaccaaatagctcttgcaatcaaaaaggaggttgaggatcttgangctgctggtattcaggtgatccagatcgatgaggcagctctaagggagggtctgccactacgcaagtcagagcatgcattctacctggactgggctgtccactctttcaggatcaccaactgcggagtccaggacaccacccagatccacacccacatgtgctactccaacttcaacgacatcatccactccatccatcgacatgggatgccgatgtgatcacgatcgagaactcccggtctgangagaa

SEQ ID NO: 1185 - DNA, 218 bp, Zea mays
aggctgcactgagagaagggctgccgctccgcaaggctgagcatgcattctacttggactgggctgtccactccttcagaatcaccaactgcgagatccaggacaccacccagatccacacccacatgtgctactccaacttcaacgacatcatccactcgatcatcgacatggacgcggacgtgatcaccatcgagaactcgcggtccgacgagaag

SEQ ID NO: 1186 - DNA, 261 bp, Zea mays
ctcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtcct

SEQ ID NO: 1187 - DNA, 282 bp, Zea mays
  unsure (1)..(282): unsure at all n locations
gcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtactatgaccaggtccttgacaacatgccatgctcggcgtgtccccgaacgttactcatggatngaggagagatggattgacaactattctccatg

SEQ ID NO: 1188 - DNA, 298 bp, Zea mays
  unsure (1)..(298): unsure at all n locations
gtgcgtcaagcctccgatcatctacggtgacgtgagccgccccaaccccatgaccnttttctggtcgaagaggcacagagcatgacgtctcgcccaatgaaggggatgctgactggcccagtcacaatcctcaatggtccttcgtccggaatgaccagccgaggtttgagacttgctaccagatcgctcttgcgatcaagaaggaagtcgaggatcttgaggctggtggtattcaggttatccaaatcgacgaggctgccactgagagaagggctgccgtccgcaaggctgagcatca

SEQ ID NO: 1189 - DNA, 228 bp, Zea mays
  unsure (1)..(228): unsure at all n locations
cccagatccacacccacatgtgctactccaacttcaacgacatcatccactncgatcatcgacatggacgcggacgtgatcaccatcgagaactcgcggtccgacgagaagctgctctccgtgttccgtgagggtgtcaagtacggcgcgggcatcggccccggtgtctacgacatccactcccccaggatcccgtcggccgaggagatcgccgaccgcatcgacaag

SEQ ID NO: 1190 - DNA, 280 bp, Zea mays
  unsure (1)..(280): unsure at all n locations
cacaattggttcattccctcagactgtggaactcaggagggttccgccgtgaatacaaggcaaagaagatcaccgaggacgaatacatcagtgccatcaaggaagaaatcagcaaggncgtcaagatccaagaggagcttgacattgatgtgcttgtgcatggagagccagagagaaatgacatggttgagtacttcggtgagcaattatctggtttgcgttcactgccaacggatgggtgcaatcctatggatcacgcttgtgtgaagccacccattat

SEQ ID NO: 1191 - DNA, 290 bp, Zea mays
  unsure (1)..(290): unsure at all n locations
ttgggaaggacaagcttgtcgtatcaacttcctgctcgctcatgcacaccgctgtggatcttgtgaacgagactaagcttgacagcgagattaagtctnggcttgcttttgctgcccagaaggttgttgaggttgatgctcttgctaaggcattggctggtcaaaaggatgaggcttacttcgcagcaaatgctgctgctcaggcctcgaggaaatcctcaccccgtgtgaccatgaagaagtccagaaggctgctgctgctctcaagggtctgaccaccgccgtgggac

SEQ ID NO: 1192 - DNA, 243 bp, Zea mays
gaccagccgaggtttgagacttgctaccagatcgctcttgcgatcaagaaggaagtcgaggatcttgaggctggtggtattcaggttatccaaatcgacgaggctgcactgagagaagggctgccgctccgcaaggctgagcatgcattctacttggactgggctgtccactccttcagaattaccaactgcgagatccaggacaccacccagatccacacccacatgtgctactccaattca

SEQ ID NO: 1193 - DNA, 223 bp, Zea mays
atggacgcagatgtgatcaccatcgagaactcccggtccgacgagaagctactgtccgtgttccgcgagggtgtgaagtacggagctggaatcggtccaggtgtctacgacatccactcgcccaggatcccctccaccgaggagatcgcggaccgcgtcaacaagatgctcgccgtgctcgacaccaacatcctctgggtgaaccctgactgcggtctcaaga

SEQ ID NO: 1194 - DNA, 246 bp, Zea mays
  unsure (1)..(246): unsure at all n locations
gctgactggcccagtcacaatcctcaactggtccttcgtccggaatgaccagccgaggtttgagacttgctaccagatcgctcttgcgatcaagaaggaagtcgaggatctcgaggctggtggtattcaggttatccaaatcgacgaggctgcactgagagaagggctgccgctccgcaaggctgagcatgcattctacttggactgggctgtccactccttnagantcaccacngggagatccng

SEQ ID NO: 1195 - DNA, 232 bp, Zea mays
  unsure (1)..(232): unsure at all n locations
tggtggtattcangatatccaaatcgacgangctgcactgagagaagggctgccgctccgcaaggctgancatgcattctacttggactnggctgtccactccttcagaattaccaactgcgagatccaggacaccacccagatccacacccacatgtgctactccaacttcaacgacatcatccactcgatcatcgacatggacgcggacgtgatcaccattgagaactcg

SEQ ID NO: 1196 - DNA, 248 bp, Zea mays
gaaatcaacaaggtcgttaagctccaagaagagcttgacattgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgacgtgagccgccccaaccccatgaccgttttctggtcgaagaggcgcagagcatgacgtctcgc

SEQ ID NO: 1197 - DNA, 300 bp, Zea mays
gtggatggacgcaacatctgggctgatgatcttgctacatctctcagcactctccagtctcttgaggctgttgttgggaaggacaagcttgtcgtatcaacttcctgctcgctcatgcacaccgctgtggatcttgtgaacgagactaagcttgacagcgagattaagtcttggcttgcttttgctgcccagaaggttgttgaggttgatgctcttgctaaggcattggctggtcaaaaggatgaggctacttcgcagcaaatgctgctgctcaggcctcgaggaaatcctcaccccgtg

SEQ ID NO: 1198 - DNA, 233 bp, Zea mays
ggtgatccagatcgatgaggcagctctaagggagggtctgccactacgcaagtcagagcatgcattctacctggactgggctgtccactctttcaggatcaccaactgcggagtccaggacaccacccagatccacacccacatgtgctactccaacttcaacgacatcatccactccatcatcgacatggatgccgatgtgatcacgatcgagaatcccggtctgacgagaa

SEQ ID NO: 1199 - DNA, 256 bp, Zea mays
gggaacgaccagccgaggtttgagacttgctaccagatcgctcttgcgatcaagaaggaagtcgaggattcttggaggctggtggtattcaggttatccaaatcgacgaggctgcactgagagaagggctgccgctccgcaaggctgagcatgcattctacttggactgggctgtccactccttcagaattaccaactgcgagatccaggacaccacccagatccacacccacatgtgctactccaacttcaacga

SEQ ID NO: 1200 - DNA, 297 bp, Zea mays
gtgagggtgtgaagtacggagctgggcattggccctggtgtctacgacatccactctcctaggattccctccaccgaggagatcgcagaccgcgtcgagaagatgctcgccgtgctcgacaccaacatcctctgggtgaaccctgactgtggtctcaagacacgcaagtacacggaggtcaagcccgccctgaccaacatggtctcggccaccaagctcatccgcacccagcttgccagcgcgaaatgagtcgtttgatagctccatggtctgatagcgcggaatgagccagtttgt

SEQ ID NO: 1201 - DNA, 260 bp, Zea mays
  unsure (1)..(260): unsure at all n locations
cacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacancttctcgtactatgaccaggtcttgaca

SEQ ID NO: 1202 - DNA, 261 bp, Zea mays
  unsure (1)..(261): unsure at all n locations
gttccgcgagggcgtcaagtacggcgcgggcatcggccccggtgtctacgacatccactcccccaggatcccgtcggctgaggagatcgccgaccgcatcgacaagatgctggcggtgctggacaccaacatcctctgggtgaaccccgactgcggcctcaagacncgcaagacccacggaggtcaagcccnccctgacnaacatggtctccgccgctaagctcatncgcacccagntcgccagcgccaagtgagcacttt

SEQ ID NO: 1203 - DNA, 246 bp, Zea mays
  unsure (1)..(246): unsure at all n locations
cccttgccaaggctttggcaggccaaaaggatgaggtctactttgcagccaatgctgctgctnnggcctcaaggagatcatcgcccagggtgacaaacgaggaggtccagaaggctgcagctgctttgaggggatctgaccaccgccgttctaccactgtttctgctagattggatgctcagcagaaaaagctcaaccttcctgtccttcccacaaccacaattggttcattccctcagactgtgg

SEQ ID NO: 1204 - DNA, 266 bp, Zea mays
  unsure (1)..(266): unsure at all n locations
gggacntggtccagtggtgancgcggacgtgatcaccattganaactcgcggtccgaagngaagctgctctccgtgttccgcnagggcgtcaagtacggcgcgggcatcggccccggtgtctacgacatccactcccccaggatcccgtcggctgaggatatcgccgaccgcatcgacaagatgctggcggtgctggacaccaacatcctctgggtgaaccccgactgcggcctcaagacccncaagtacacggaggtcnagcccg

SEQ ID NO: 1205 - DNA, 302 bp, Zea mays
  unsure (1)..(302): unsure at all n locations
ccccaaccccatgaccgttttcnggtcgaagacggcacagagcatgacgtctcgcccaatgaaggggatgctgactggcccagtcacaatcctcaactggtccttcgtccggaatgaccagccgangtttgagacttgctaccagatcgctcttgcgatcaagaaggaagtcgaggatcttgagtntggtggtattcaggttatccaaatcgacgaggctgcactgaganaagggcnnnncgctccgcaaggctgagcatgcattctaattgganggntcatccttcagattacactgngag

SEQ ID NO: 1206 - DNA, 319 bp, Zea mays
  unsure (1)..(319): unsure at all n locations
gcagtcttatgggtcaaggtgcgtcaagcctccgatcatctacggtgacgtgagccgccccaaccccatgaccgttttctggtcgaagacggcgcagagcatgacgtctcgcccaatgaaggggatgctgactggcccagtcacaatcctcaactggtccttcgtccggaatgaccagccgaggtttgagacttgctaccagatcgctcttgcgatcaagaaggaatcgaggactcgaggctggtggtatcagttaccaancgagagtgcntgagagaaggtgcgtcgcagntgacnnatctattgatggtgtcatctc

SEQ ID NO: 1207 - DNA, 299 bp, Zea mays
  unsure (1)..(299): unsure at all n locations
aacccaaactcttgggcttgtcacgagtgctggtttccctgctggaaagtacctctttgctggtgttgtggatggacgcaacatctgggctgatgatcttgctacatctctcagcantctccagtctcttgaggctgttgttgggaaggacaagcttgtcgtatcaacttcctgctcgctcatgcacaccgctgtggatcttgtgaacgagactaagcttgacagcgagattaagtcttggcttgcttttgctgcccagaangttgttgagttgatgtcttgctaaaggcattgctggt

SEQ ID NO: 1208 - DNA, 315 bp, Zea mays
  unsure (1)..(315): unsure at all n locations
gctcgctcatgcacaccgctgtggatcttgtgaacgagactaagcttgacagcgagattaantncttggcctgntttgctgcccagaaggttgttgaggttgatgctcttgctaaggcattggctggtcaaaaggatgaggcttacttcgcagcaaatgctgcngtcaggcctcgaggaaatcctcaccccgtgtgaccaatgaagaagtccagaaggctgntgctgctctcaagggctctgaccaccgccgtgggaccaacgttagtgctagatggatgcccagcngtnagnagcttaacctccccanccttcc

SEQ ID NO: 1209 - DNA, 421 bp, Zea mays
  unsure (1)..(421): unsure at all n locations
cccactctttcgtgggtnaggacaagcttgtcntatcaagttcctggggggctcatgcacaccgntgtggatcttgtgaacgagactaatcttgacagcgagattaagtcttggcttgcttttgctgcccagaaggttgttgaggttgatgctcttgctaaggcattggctggtcaaaaggatgaggcttacttcgcagcaaatgctgctgctcaggcctcgaggaaatctcaccccgtntgaccaatgaanaantccanaaggctgctgctgctctcaagggctctgaccaccggcgtnggaccaacgttagtgctagattggatgcccacaaangaaacttaacctcccattcttccaccacttcaattggttcgttnccacaaacccgttgagctcaagaaggtccgccgtgagtaca

SEQ ID NO: 1210 - DNA, 261 bp, Zea mays
catcggccccggtgtctacgacatccactcccccaggatcccgtcggccgaggagatcgccgaccgcatcgacaagatgctggccgtgctggacaccaacatcctctgggtgaaccccgactgcggcctcaagacccgcaagtacacggaggtcaagcccgccctgaccaacatggtctccgctgctaagctcattcgcacccagctcgccagcgccaagtgagcacctttttttgcctttttcgtttccgaggagggcgt

SEQ ID NO: 1211 - DNA, 239 bp, Zea mays
gggaaggacaagcttgtcgtatcaacttcctgctcgctcatgcacaccgctgtggatcttgtgaacgagactaagcttgacagcgagattaagtcttggcttgcttttgctgcccagaaggttgttgaggttgatgctcttgctaaggcattggctggtcaaaaggatgaggcttacttcgcagcaaatgctgctgctcaggcctcgaggaaatcctcaccccgtgtgaccaatgaaga

SEQ ID NO: 1212 - DNA, 236 bp, Zea mays
atcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacactttctcgtacta

SEQ ID NO: 1213 - DNA, 276 bp, Zea mays
cccacatctcagttcaccccggcgtcgtcctcttcccccggcgctactctcccgctccacgttccaaaggaaagatggcgtcccatattgttggataccctcgcatgggccccaagagagagctcaagtttgccttggagtctttctgggatgggaagagcagcgccgatgatttagagaaagttgcctctgacctcaggtctagcatctggaagcaaatgtcagaagctgggatcaagtacattcccagcaacaccttctcgtactatgaccagg

SEQ ID NO: 1214 - DNA, 231 bp, Zea mays
  unsure (1)..(231): unsure at all n locations
ggtgcgtcaagcctccgatcatctacggtgacgtgagccgccccaaccccatgaccgttttctggtcgaagacggcgcagagcatgacgtctcgcccaatgaaggggatgctgantggcccagtcacaatcctcaactggtccttcgtccggaatgaccagccgaggtttgaganttgcnancagatcgctcttgcgatcaagaaggaagtngaggatctcgangctagtg

SEQ ID NO: 1215 - DNA, 284 bp, Zea mays
ctcttgtcctcgaccttgattctgacaaattggctgcattctctgctgcatacgcagaacttgaatctgtactttctggattgaatgtgcttgttgagacttactttgctgatgttcctgctgagtcctacaagaccctaacatctctgagcagtgtgactgcttatggttttgatcttgtccgtggaacccaaactcttgggcttgtcacgagtgctggtttccctgctggaaagtacctctttgctggtgttgtggatggacgcaacatctgggctgatgat

SEQ ID NO: 1216 - DNA, 280 bp, Zea mays
ccaaactcttgggcttgtcacgagtgctggtttccctgctggaaagtacctctttgctggtgttgtggatggacgcaacatctgggctgatgatcttgctacatctctcagcactctccagtctcttgaggctgttgttgggaaggacaagcttgtcgtatcaacttcctgctcgctcatgcacaccgctgtggatcttgtgaacgagactaagcttgacagcgagattaagtcttggctgcttttgctgcccagaaggttgttgaggttgatgctcttg

SEQ ID NO: 1217 - DNA, 283 bp, Zea mays
  unsure (1)..(283): unsure at all n locations
cgtactatgancaggtccttgtgcaccagtgccatgctcggcgctgtccccgcacgctactcatggactggaggagagattgggtttgacacctacttctccatggccaggggcaacgccactgtccctgctatggagatgaccaagtggtttgacaccaactaccactttattgtccctgaattgggcccaaacaccaagttctcctatgcttctcacaaggctgttaacgaatataaggaggctaggcgctcggtgttgatacgtgccagtattgntggac

SEQ ID NO: 1218 - DNA, 337 bp, Zea mays
  unsure (1)..(337): unsure at all n locations
agggattccctcttctttcncttcttancagcatcctcccagtctacaaggnngtcattgctgagttnaaggcagctggggcttcatggattcagtttgatgagcccactcttgncctcgancttgattctgacaaattggctgcattctctgctgcatacgcagaacttgaatctgtactttctggattgaatgtgcttgttgagacttactttgctgatgntcctgctgantcctacaagaccctaacatctctgagcagtgtgactgcttatggttttgatctgtccgtngaacccaaaccttgggcttgtcacgagtgctggntccctgctgg

SEQ ID NO: 1219 - DNA, 446 bp, Zea mays
  unsure (1)..(446): unsure at all n locations
gagctggaatcggtccaggtgtctacgacttccactcgcccaggatcccctccaccgaggagatcgcggaccgcgtcaacaagatgctcgccgtgctggacaccaacatcctctgggtgaaccctgactgcggtctcaagacacgcaagtacacggaggtgaagcctgccctgaccaacatggtctccgccaccaagctcatccgcacccagctcggcagcgcgaaatgagtcagatttggtagatccatggtttgttgaacacaaaagccagcagggtcatttgtttcgaataatttgggtccttactcctgttccatggcgttaggttaagcctcattggtgttggtggggtaccggcgttacgtgtccgtgttctaaagtttggaatgtgtgtttctcttttttggtnggggtttgngtgcctttgggtatataaacagaaat

SEQ ID NO: 1220 - DNA, 228 bp, Zea mays
  unsure (1)..(228): unsure at all n locations
ggcaaagaagatctccgaggaggaatacatcagtgccatcaangaagaaatcagcaaggttgtcaagntccaagaggagcttgacnttgatgtgcttgtgcatggagagccagaaagaantgacatggttgagtacttcggtgagcanttatctggttttgcantcactgccaacggntgggtgcnatctttatggatcacgttgtgtgaagccaccnttatctatgg

SEQ ID NO: 1221 - DNA, 232 bp, Zea mays
caacttcctgctcgctcatgcacaccgctgtggatcttgtgaacgagactaagcttgacagcgagattaagtcttggcttgcttttgctgcccagaaggttgttgaggttgatgctcttgctaaggcattggctggtcaaaaggatgaggcttacttcgcagcaaatgctgctgctcaggcctcgaggaaatcctcaccccgtgtgaccaatgaagaagtccagaaggctgc

SEQ ID NO: 1222 - DNA, 217 bp, Zea mays
  unsure (1)..(217): unsure at all n locations
aggatcttnaggctgntggtattcaggngatccagattgatgaggcagctctaaggnagggtctgccactgcgcaagtcagagcatgcattctacctggactgggctgtccactctttcagaatcacnaactgcggagtccaggacaccacccagatccanacccatatgtgctactccaacttcaacgacatcatccactccatcatcgacatgga

SEQ ID NO: 1223 - DNA, 277 bp, Zea mays
  unsure (1)..(277): unsure at all n locations
ggcgctcggtgttgataccgtgccagtacttgttggaccagtctcgtacctgttgctctcaaagcccgccaagggtgtggagaagggattccctcttctttcccttcttagcagcatcctcccagtctacaaggaggtcattgctgagttgaaggcagctggggcttcatggattcagtttgatgagcccactcttgtcctcgaccttgattctgacaaattggctgcattctctgctgcatacgcagaacttgaatctgtattntganttnatggg

SEQ ID NO: 1224 - DNA, 206 bp, Zea mays
  unsure (1)..(206): unsure at all n locations
aagaagatcaccgaggacgaatacatcagtgccatcaaggaagaaatcagcaaggttgtcaagatccaagaggagcttgacattgatgtgcttgtgcatggagagccagagagaaatgacatggttgagtacttcggtgagcaattatctggttttgcgttcactgccaacggatgggtgcaatcctatggntcacgctgtgtgac

SEQ ID NO: 1225 - DNA, 354 bp, Zea mays
  unsure (1)..(354): unsure at all n locations
atatggttgagtacttcngtnagcagctctgcggttatgcgttcactgccaatggctgggtgcagtcttatgggtcaaggtgngtcaagcctgccgattcatctactgnaacgtgtatgccgccaccaacnccatgaccgttttctggtcgnnnacggcgcagagcatgacgtctcgcccaatgaatgggatgntgactngcncagtcacantcctcaactngtcctncgtcggaatgaccagccgaggtntganacttgctaccagatcgctctngcgatnaagnnggnagtcgaggtctcgacgtggngtatcaggtgaccaantcgacnagctgcatgagagagagcgcgc

SEQ ID NO: 1226 - DNA, 228 bp, Zea mays
  unsure (1)..(228): unsure at all n locations
gcagctctccggttttgcgttcactgccaatggctgggtgcagtcttatgggtcaaggtgcgtcaagcctccgatcatctacggtgacgtgagccgccccaaccccatgaccgttttctggtcgaagaggcgcagagcatgacgtctcgcccaatgaaggggatgctgactggcccagtcacaatcctcaactggtccttcgtccggaatnaccagccgaggttttat

SEQ ID NO: 1227 - DNA, 260 bp, Zea mays
  unsure (1)..(260): unsure at all n locations
cgnacntgggtntncgtcaggaacgaccagcctaggtttgagacatgctaccaaatagctcttgcaatcaaaaaggaggttgaggatcttgangctgctggtaantcaggtgatccagatcgatgaggcagctctaagggagggtctgccactacgcaagtcagagcatgcattctacctggactgggctgtccactctttcaggatcaccaactgcggagtccaggacaccacccagatccacacccacatgtgctact

SEQ ID NO: 1228 - DNA, 276 bp, Zea mays
  unsure (1)..(276): unsure at all n locations
cgtactatgaccaggtccttgacaccacntgccatgctcggcgctgtccccgaacgctactcatggactggaggagagattgggtttgacacctacttctccatggccaggggcaacgccactgtccctgctatggagatgaccaagtggtttgacaccaactaccactttattgtccctgaattgggcccaaacaccaagttctcctatgcttctcanaaggctgttaangaatataagaggctaaggcgctcggtgttaanaccggccaatant

SEQ ID NO: 1229 - DNA, 256 bp, Zea mays
gtacttgttggaccagtctcgtacctgttgctctcaaagcctgccaagggtgtggagaagggattccctcttctttcccttcttagcagcatcctcccagtctacaaggaggtcattgctgagttgaaggcagctggggcttcatggattcagtttgatgagcccactcttgtcctcgaccttgattctgacaaattggctgcattctctgctgcatacgcagaacttgaatctgtactttctggattgaatgtgc

SEQ ID NO: 1230 - DNA, 257 bp, Zea mays
ggtgcgtcaagcctccgatcatctacggtgacgtgagccgccccaaaccccatgaccgttttctggtcgaagaggcacagagcatgacgtctcgcccaatgaaggggatgctgactggcccagtcacaatcctcaactggtccttcgtccggaatgaccagccgaggtttgagacttgctaccagatcgctcttgcgatcaagaaggaagtcgaggatcttgaggctggtggtattcaggttatccaaatcgacgag

SEQ ID NO: 1231 - DNA, 344 bp, Zea mays
gggattccctcttctttcccttcttagcagcatcctcccagtctacaaggaggtcattgctgagttgaaggcagctggggcttcatggattcagtttgatgagcccactcttgtcctcgaccttgattctgacaaattggctgcattctctgctgcatacgcagaacttgaatctgtactttctggattgaatgtgcttgttgagacttactttgctgatgttcctgctgagtcctacaagaccctaacatccctgagcagtgtgactgcttatggtttgacttgtccgtggaacccaaactcttgggttgtcacgagtgctggtttccctgctggaagtactc

SEQ ID NO: 1232 - DNA, 278 bp, Zea mays
  unsure (1)..(278): unsure at all n locations
gtcccacattgttggataccctcgcatgggccccaagagggagcnccaagtttgcacttgagtctttctgggatgggaagannaccgctgaggatctggagaaggttgctaccgacctcagggccagtatctggaagcagatggnngatgctggggatcaagtacatccccagcaacactttctcgtactatgaccaggtccttgacaccactgccatgctcggcgctgtccccgaacgttactcatggactggaggagagattggatttgacactac

SEQ ID NO: 1233 - DNA, 249 bp, Zea mays
cttcctgctcgctcatgcacaccgctgtggatcttgtgaacgagactaagcttgacagcgagattaagtcttggcttgcttttgctgcccagaaggttgttgaggttgatgctcttgctaaggcattggctggtcaaaaggatgaggcttactcgcagcaaatgctgcagctcaggcctcgaggaaatcctcaccccgtgtgaccaatgaagaagtccagaaggctgctgctgctctcaagggctctga

SEQ ID NO: 1234 - DNA, 295 bp, Zea mays
  unsure (1)..(295): unsure at all n locations
accacccacatctcagttcancccggcgtcgtcctcttcccccggngctactctcccgctccacgttccaaaggantgctggcgtcccatattgttggataccntcgcatgggccccaagagagagctcaagtttgccttggagtctttctgggatgggaagagcagcgccgatgatttagagaaagttgcctctgacctcaggtctagcatctggacngccnatgtcagangctgggntcnagtacattcccagcaacaccttctcgtactatgaccaggtccttgataccagg

SEQ ID NO: 1235 - DNA, 267 bp, Zea mays
  unsure (1)..(267): unsure at all n locations
aacccaaactcttgggcttgtccacgagtgctggtttccctgctggaaagtacctctttgctggtgttgtggatggacgcaacatctgggctgatgatcttgctacatctctcagcactctccagtctcttgaggctgttgttgggaaggacaagcttgtcgtatcaacttcctgctcgctnntgcacaccgctgtggatcttgtgaacgagactaagcttgacagcgagattaagtctggctgcttttgctgcccagaaggttgtt

SEQ ID NO: 1236 - DNA, 292 bp, Zea mays
  unsure (1)..(292): unsure at all n locations
attggccctggtgtctacgacatccactctcctaggattccctccaccgaggagatcgcagaccgcgtcgagaagatgctcgccgtgctggacaccaacatcctctgggtgaaccctgactgtggtctcaagacacgcaagtacacggaggtcaagcccgccctgaccaacatggtctcggccancaagctcatccgcacccagcttgccaacgcgaaatgagtcgtttgatagctccatggtttgatagcgcggaatgagccagttgttttgaataatttgggtgntaccc

SEQ ID NO: 1237 - DNA, 217 bp, Zea mays
  unsure (1)..(217): unsure at all n locations
ccaagaanancttgacattgatgtgcttgtgcatggcgagcctnagagaaacgatatggttgagtacttcngtgagcagctctccggttttgcgttcactgccaatggctgggtgcagtcttatgggtcaaggtncgtcangcctccgntcatctacggtgacgtgagccgccccaaccccatgaccgtnttctggtcgnagactgcgcagagcatg

SEQ ID NO: 1238 - DNA, 456 bp, Zea mays
  unsure (1)..(456): unsure at all n locations
gtacggcgcgggcatcgnccccggtgtctntnntatccactcccccaggatcccgtcgggngaggntatcgccgaccgcatcgacaagatgctggcggtgctggacaccaacatcctctgggtgaaccccgactgcggcctcaagacccgcaagtacacggaggtcaagcccgccctgaccaacatggtctccgccgctaagctcatccncacccagctcgccagcgccaagtgagcaccttttttttgcctttttcgtttccgaggagggcgtcgtcnantgccaatttggttncaataaacagggctntgcccgccgttctgttgtactccgtctgtggttaggttagtagttatcttgatctcgcnnncacgccggtacctntttactactctctgtttggtggttttctgaagcaagttgcccntttacttgtatngtaaaaacccaatngt

SEQ ID NO: 1239 - DNA, 289 bp, Zea mays
  unsure (1)..(289): unsure at all n locations
cgccgctgcgccgtctcctcngctnccgtcgtccggaaagatggcgtnccacattgttggataccctcncatgggccccaagagggagctcaagtttgcacttgagtctttctgggatgggaagagcaccgctgaggatctggagaaggttgctaccgacctcagggccagtatctggaagcagatggctgatgctgggatcaagtacatccccagcaacatttctcgtactatgaccagtcctgacaccatgccatgtcggcgctgtccccgaaggtactcatggatg

SEQ ID NO: 1240 - DNA, 274 bp, Zea mays
  unsure (1)..(274): unsure at all n locations
ggaggctaaggcgctcggtgttgataccgtgccagtacttgttggaccantctcgtacctgttgctctcaaagcctgccaagggtgtggagaagggattccctcttctttcccttcttagcagcatcctcccagtctacaaggaggtcattgctgagttgaaggcagctggggcttcatggattcagtttgatgagcccactcttgtcctngacctgaattcggnacaaatnggctgcattctcngcngcatangcngaanttgaatctgtact

SEQ ID NO: 1241 - DNA, 268 bp, Zea mays
  unsure (1)..(268): unsure at all n locations
atcgcngctgcgccgtctcctccgctcccgtcgtccggaaagatggcgtcccacattgttggataccctcgcatgggncccnaganggagctcaagtttgcacttgagtctttctgggatgggnagagcaacgctgaggatctggagaaggttgctaccgacntcagggccagtatccggaagcanatggcngatnctgggatcaagtacatccccagcaanacnttctcgnantatgaccaggtcttganaccatgccatggctcgg

SEQ ID NO: 1242 - DNA, 260 bp, Zea mays
acgacatccactcccccaggatcccgtcggctgaggagatcgccgaccgcatcgacaagatgctggcggtgctggacaccaacatcctctgggtgaaccccgactgcggcctcaagacccgcaagtacacggaggtcaagcccgccctgaccaacatggtctccgccgctaagctcatccgcacccagctcgccagcgccaagtgagcaccttttttttgcctttttcgtttccgaggagggcgtcgtcgatgccaattt

SEQ ID NO: 1243 - DNA, 280 bp, Zea mays
  unsure (1)..(280): unsure at all n locations
ctcgcggtccgacgagaagctgctctccgtgtnccgcgagggcgnccaagtacggcgcgggcatcggccccggtgtctacgacatccactcccccaggatcccgtcggctgaggagatcgccgaccgcatcgacaagatgctggngtgctggacaccaacatcctctgggtgaaccccgactgcggcctcaagacccgcaagtacacggaggtcaagcccgccctgaccancatggtctcngccggtaagctnatccgcacccagctcgcnaggccaagt

SEQ ID NO: 1244 - DNA, 305 bp, Zea mays
  unsure (1)..(305): unsure at all n locations
ccactcntgtcctcgaccttgattctgacaaattggctgcattctctgctgcatacgcagaacttgaatctgtactttctggattgaatgtgcttgttgagacttactttgctgatgttcctgctgagtcctacaagaccctaacanctctgagcagtgtgactgctnatggttttgatcttgtccgtggaacccaaactctnggggcttgtcacgagtgctgggtttccctgctggaaagtacctctttgctggtgttgtggatggacncaacagctggggtngatgntcttncnnacntcgcc

SEQ ID NO: 1245 - DNA, 198 bp, Zea mays
  unsure (1)..(198): unsure at all n locations
cgccccaaccccatgaccgttttctggtcgaagacggcgcagagcatgacgtctcgcccaatganggggatgctgactggcccagtcacaatcctcaactggtccttcgtccggaatgaccagccgaggtttgagacttgctaccagatcgctcttgcgatcaagaaggaagtcgaggatctcgaggctggtggtatt

SEQ ID NO: 1246 - DNA, 297 bp, Zea mays
ctcccagtctacaaggaggtcattgctgagttgaaggcagctggggcttcatggattcagtttgatgagcccactcttgtcctcgaccttgattctgacaaattggctgcattctctgctgcatacgcagaacttgaatctgtacttctggattgaatgtgctgttgagacttactttgctgatgttcctgctgagtcctacaagaccctaacatctctgagcagtgtgactgcctatggttttgatcttgtccgtggaacccaaactcttgggcttgtcacgagtgctggtttccc

SEQ ID NO: 1247 - DNA, 286 bp, Zea mays
  unsure (1)..(286): unsure at all n locations
tccantcgatcatnggnatggacgcggatgtnattcaccattgagaactcgcggtccgacgagaagctgctctccgtgttccgcgagggcgtcaagtacggcgcgggcatcggccccggtgtctacgacatccactcnnccaggatcccgtcggctgaggagatcgccgaccgcatcgacaagatgtgnggtgctgganacnaacatcctctnggtgaaccccgactgcggcctcaaganccgcaagtacacngaggtcaaancggnctgaccaacangtctccgt

SEQ ID NO: 1248 - DNA, 343 bp, Zea mays
  unsure (1)..(343): unsure at all n locations
cngtgacgtgagccgccccaaccccatgaccgttttctggtcgaagacgggcgcagagcatgacgtctcagcccaatgaanggggnnntgactggccaagtcacaatncctcaactggtccttcgtccggaatgaccagccgaggtttgagacttgctaccagatcgctcttgcgatcaagaaggaagtcgaggatctcgaggctggtggtattcaggttatccaaatcgacgaggctgcactgagagaagggctgccgctccgcaaggctgnagcatgcatcttacttggatgggctgttccattccttcagaatcaccaatgcgaatccaggacaccaccc

SEQ ID NO: 1249 - DNA, 210 bp, Zea mays
gagacatgctaccaaatagctcttgcaatcaaaaaggaggttgaggatcttgaggctgctggtattcaggtgatccagatcgatgaggcagctctaagggagggtctgccactacgcaagtcagagcatgcattctacctggactgggctgtccactctttcaggatcaccaactgcggagtccaggacaccacccagatccacacccac

SEQ ID NO: 1250 - DNA, 206 bp, Zea mays
  unsure (1)..(206): unsure at all n locations
gcttttgctgcccagaaggttgttgaggttgatgctcttgctaaggcattggctggtcaaaaggatgaggcttacttcgcagcaaatgctgcagctcaggcctcgaggaaatcctcaccccgtgtgaccaatgaagaagtccagaaggctgctgctgctctcaagggctctgaccaccgccgtgcgaccaacgttagtgctagntt

SEQ ID NO: 1251 - DNA, 223 bp, Zea mays
  unsure (1)..(223): unsure at all n locations
gaccagccgaggtttgagacttgctaccagatcgctcttgcgatnaagaaggaagtcgaggatcttgaggctggtggtattcaggttatccaaatcgacgaggctgcactgagagaagggntgccgctccgcaaggctgatcatgcattctacttggactgggctgtccantccttcagnattaccaactgcgagatccaggacaccacccagatccacaccc

SEQ ID NO: 1252 - DNA, 186 bp, Zea mays
acaaaccgttgagctcaggagggtccgccgtgagtacaaggcaaaaaagatctctgaggaggaatacgtcactgccatcaaggaggaaatcaacaaggtcgttaagcttcaagaagagcttgacattgatgtgcttgtgcatggcgagcctgagagaaacgatatggttgagtacttcggtgagca

SEQ ID NO: 1253 - DNA, 238 bp, Zea mays
  unsure (1)..(238): unsure at all n locations
cnagatggcgtcccatattgttggataccctcgcatgggccccaagagggagctgcaagtttgcnttggagtactttctgggatgggnagagcagcgccgaggatttggagaangttgncactgacctgaggtctagcatctggnagcaaatgtcagangctgggatcaagtacattcccaggcaatcaccttctcgtactacgaccaggttcttgataccacggccatgcttggcgc

SEQ ID NO: 1254 - DNA, 277 bp, Zea mays
  unsure (1)..(277): unsure at all n locations
gcccttgccaaggctttggcaggccaaaaggatgaggtctactttgcagccaatgctgctgcttcaggcctcaaggagatcatcgcccagggtgacaaacgaggaggtccagaaggctgcagctgctttgaggggatctgaccaccgccgttctaccactgtttctgctagattggatgctcagcagaanaagctcaaccttcctgtccttcccacaaccacaattggttcattccctcagactgtggaatcaggagggttcgccgtgaatacaagg

SEQ ID NO: 1255 - DNA, 287 bp, Zea mays
cctgagacagtcagacgtcccgtgctcgtcatcaccacccacatctcagttcaccccggcgtcgtcctcttcccccggcgctactctcccgctccacgttccaaaggaaagatggcgtcccatattgttggataccctcgcatgggccccaagagagagctcaagtttgccttggagtctttctgggatgggaagagcagcgccgatgatttagagaaagttgcctctgacctcaggtctagcatctggaagcaaatgtcagaagctgggatcaagtacattcccag

SEQ ID NO: 1256 - DNA, 219 bp, Zea mays
gggcccaaacaccaagttctcctatgcttctcacaaggctgttaacgaatataaggaggctaaggcgctcggtgttgataccgtgccagtacttgttggaccagtctcgtacctgttgctctcaaagcctgccaagggtgtggagaagggattccctcttctttcccttcttagcagcatcctcccagtctacaaggaggtcattgctgagttgaaggc

SEQ ID NO: 1257 - DNA, 269 bp, Zea mays
  unsure (1)..(269): unsure at all n locations
gtccggaatgaccagccgaggtttgagacttgctaccagatcgctcttgcgatcaagaaggaagtcgaggatctcgaggctggtggtattcaggttatccaaatcgacgaggctgcactgagagaagggctgccgctccgcaaggctgagcatgcattctacttggactgggctgtccactccttcagaatcaccaactgcggagatccaggacaccacccatatccaaacccanatgtgctattcnancttnaacgacatcatccact

SEQ ID NO: 1258 - DNA, 213 bp, Zea mays
caacttcctgctcgctcatgcacaccgctgtggatcttgtgaacgagactaagcttgacagcgagattaagtcttggcttgcttttgctgcccagaaggttgttgaggttgatgctcttgctaaggcattggctggtcaaaaggatgaggcttacttcgcagcaaatgctgctgctcaggcctcgaggaaatcctcaccccgtgtgaccaatg

SEQ ID NO: 1259 - DNA, 269 bp, Zea mays
  unsure (1)..(269): unsure at all n locations
atttggttgccctggccggtacnagtccaagaattcccgggtcctcacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggctgatgctgggatcaagtacatcccc

SEQ ID NO: 1260 - DNA, 266 bp, Zea mays
  unsure (1)..(266): unsure at all n locations
catgacgtctcgcccaatgaaggggatgctgnctggcccagtcacaatcctcaactggtccttcgtccggaatgaccagccgaggtttgagacttgctaccagatcgctcttgcgatcaagaaggaagttcgaggatcttnaggctggtggtattcaggttatccaaatccgacgaggctgcactgagnagaagggctgccgctccgcaaggccgagcatgccatctacttgnactgggctgtccactccttcagattaccaactg

SEQ ID NO: 1261 - DNA, 443 bp, Zea mays
  unsure (1)..(443): unsure at all n locations
acggtttngggcatcggccccggtgtctacgacatgcactcccccaggatcccgtcggctgaggagatcgccgaccgcatcgacaagatgctggcggtgctggacaccaacatcctctgggtgaaccccgactgcggcctcaagacccgcaagtacacggaggtcaagcccgcctgaccaacatggtctccgccgctaagctcatccgcacccagctcgccagcgccaagtgagcaccttatntttgcntntttngtttccgaggagggcgtngtcgatgccaattngngttcaataaacagggctgtgcccgcccgttctgtngactncgctgtgggttaagttagtantttcttngatctcgcncccacgcggtacctggtttactactctctgtttggtggttcttgaagcaagttacnncntgtacttggatagaaaaa

SEQ ID NO: 1262 - DNA, 258 bp, Zea mays
ggcagctggggcttcatggattcagtttgatgagcccactcttgtcctcgaccttgattctgacaaattggctgcattctctgctgcatacgcagaacttgaatctgtactttctggattgaatgtgcttgttgagacttactttgctgatgttcctgctgagtcctacaagaccctaacatctctgagcagtgtgactgcttatggttttgatcttgtccgtggaacccaaactcttgggcttgtcacgagtgctgg

SEQ ID NO: 1263 - DNA, 275 bp, Zea mays
ggcagctggggcttcatggattcagtttgatgagcccactcttgtcctcgaccttgattctgacaaattggctgcattctctgctgcatacgcagaacttgaatctgtactttctggattgaatgtgcttgttgagacttactttgctgatgttcctgctgagtcctacaagaccctaacatctctgagcagtgtgactgcttatggttttgatcttgtccgtggaacccaaactcttgggcttgtcacgagtgctggtttccctgctggaaagt

SEQ ID NO: 1264 - DNA, 253 bp, Zea mays
  unsure (1)..(253): unsure at all n locations
ctacgacatccactctcctaggattccctccacagaggagatcncagaccgcgtcgagaagatgctcgccgtgctcgacaccaacatcctctgggtgaaccctgactgtggtctcaagacacgcaagtacacggaggtcaagcccgccctgaccaacatggtctcggccaccaagctcgcncgcacccagcttgccagcgcgaaatgaggtcgtttgatagctccatggtctgatagcgcggaatgagccagt

SEQ ID NO: 1265 - DNA, 211 bp, Zea mays
  unsure (1)..(211): unsure at all n locations
ggctgctgctctcaagggctctgaccaccgccgtgggaccaacgttagtgctagattggatgcccagcagaagaagcttaacctccccatccttcccaccactacaatcggttcgttcccacaaaccgttgagctcaggagggtccgccgtgagtacaaggcaaaaaagatctctgaggaagaatacgtcactggccatcnaggaggaaat

SEQ ID NO: 1266 - DNA, 297 bp, Zea mays
gctgagttgaaggcagctggggcttcatggattcagtttgatgagcccactcttgtcctcgaccttgattctgacaaattggctgcattctctgctgcatacgcagaacttgaatctgtactttctggattgaatgtgctgttgagacttactttgctgatgttcctgctgagtcctacaagaccctaacatctctgagcagtgtgactgcctatggttttgatcttgtccgtggaacccaaactcttgggcttgtcacgagtgctggtttccctgctggaaagtactcttgctggt

SEQ ID NO: 1267 - DNA, 267 bp, Zea mays
atccctgagcagtgtgactgcttatggttttgatcttgtccgtggaacccaaactcttgggcttgtcacgagtgctggtttccctgctggaaagtacctctttgctggtgttgtggatggacgcaacatctgggctgatgatcttgctacatctctcagcactctccagtctcttgaggctgttgttgggaaggacaagcttgtcgtatcaacttcctgctcgctcatgcacaccgctgtggatcttgtgaacgagactaagcttga

SEQ ID NO: 1268 - DNA, 224 bp, Zea mays
  unsure (1)..(224): unsure at all n locations
ccgctgcgccgtctccnccgcncccgtcgtccggancngatggcgtcccacattgttggatacnctcgcatggnccccaanagggagctcaagtttgcacttnagtctttcngggatnggaagancacngctgaggatcncgagaaggtngcnaccgacctcagggccagtatctggaagcagatngctgannctgggatcaantacatncccagcaacacttt

SEQ ID NO: 1269 - DNA, 212 bp, Zea mays
  unsure (1)..(212): unsure at all n locations
nnnnnnnnnnnnnnnngacatggacgcggacgtgatcaccatcgagaactcgcggtccgacgagaagctgctctccgtgttccgtgagggtgtcaagtacggcgcgggcatcggccccggtgtctacgacatccactcccccaggatcccgtcggccgaggagatcgccgaccgcatcgacaagatgctggccgtgctggacaccaacatca

SEQ ID NO: 1270 - DNA, 292 bp, Zea mays
  unsure (1)..(292): unsure at all n locations
cgagangctgctctccgtgttcngcgngggcgtcaagtacggngcgggcntcggcctcggtgtctacgacatcnnctcccccaggntnccgtcngctgnggagatcgccgaccgcatcgacaagatgctggcggtgctggacaccaacatcctctgggtgaaccccgactcggcctcaagacccgcaagtacacggnggtcaagcccgccctgaccaacatggtntcgccgctnagtcatccgacccagctcgnnagccgcgangtgagcacttttttgccttttcgttccg

SEQ ID NO: 1271 - DNA, 287 bp, Zea mays
  unsure (1)..(287): unsure at all n locations
angcaacatctgggctgatgatcttgctacatctctcagcactctccagtctcttgaggctgttgttgggaaggacaagcttgtcgtatcaacttcctgctcgctcatgcacaccgctgtggatcttgtgaacgagactaagcttgacagcgagattaagtcttggcttgcttttgctgcccagaaggttgttgaggtgatgctcntgctaaggcattggctggtcaaaaggatgaggntacttcgcagcaaatgcngcagctcaggncncgaggaaatcctcaccc

SEQ ID NO: 1272 - DNA, 265 bp, Zea mays
  unsure (1)..(265): unsure at all n locations
tcaccacccacatctcagttcaccccggcgtcgtcctcttcccccggcgctactctccngctccacgttccaaaggaaagatggcgtacncatattgntggataccctcgcatgggccccaagagagagctcaagtttgccttggagtctttctgggatgggaagagcagcgccgatgatttagagaaagttgcctctgacctcaggtctagcatctggaagcanatgtcagaagctgggatcaagtacattcccagcaacacct

SEQ ID NO: 1273 - DNA, 223 bp, Zea mays
tagcagcatcctcccagtctacaaggaggtcattgctgagttgaaggcagctggggcttcatggattcagtttgatgagcccactcttgtcctcgaccttgattctgacaaattggctgcattctctgctgcatacgcagaacttgaatctgtactttctggattgaatgtgcttgttgagacttactttgctgatgttcctgctgagtcctacaagacccta

SEQ ID NO: 1274 - DNA, 261 bp, Zea mays
  unsure (1)..(261): unsure at all n locations
ctgggatgggaagagcaccgctgaggatctggagaaggttgctaccgacctacagggccagtatctggaagcagatggctgangctgggatcaagtacatccccagcaacactttctcgtactatgaccaggtccttgacaccactgccatgctcggcgctgtccccgaacgttactacatggactggaggagagattggatttgacacctacttctccatggccaggggcaagccactgttcctgctatggagatgacca

SEQ ID NO: 1275 - DNA, 283 bp, Zea mays
  unsure (1)..(283): unsure at all n locations
tggtgttgtggatggacgcaacatctgggctgatgatcttgctacatctctcagcantntccaggctnntgagngctgttgttgggaatgacaagcttgtcgtatcaacttcctgctcgctcatgcacaccgctgtggatcttgtgaacgagactaagcttgacagcgagattaagtcttggcttgcttttgctgcccagaaggttgttgaggttgatgcnctgctaaggcatggctggtcaaaaggatgaggcttacttcgcagcaaatgctgcagctcagg

SEQ ID NO: 1276 - DNA, 185 bp, Zea mays
  unsure (1)..(185): unsure at all n locations
gcgtcccacattgttggatacccnacgcatgggccccaagagggagctacaagtttgcacttgagtcttnctgggatgggaagagcaccgctgaggatctggagaaggttgctaccgacctcagggccagtatctggnagcagatggctgatgctgggatcaagtacatccccagcaacactttc

SEQ ID NO: 1277 - DNA, 278 bp, Zea mays
  unsure (1)..(278): unsure at all n locations
tcagtttgatgagcccactcttgtcctcgaccttgattctgacanattggctgcaanctctgctgcatacgcagaacttgaatctgtactttctggattgaatgtgcttgttgagacttactttgctgatgttcctgctgagtcctacaagaccctaacatccctgagcagtgtgactgcttatggttttgatcttgtccgtggaacccaaactcttgggcttgtcacgagtgctggtttccctgctggaaagtactctttgctggtgttgtggatga

SEQ ID NO: 1278 - DNA, 276 bp, Zea mays
  unsure (1)..(276): unsure at all n locations
ccaggatcccgtcggccgaggagatcgccgaccgcatcgacaagatgctggccgtgctggacaccaacatcctctgggtgaaccccgactgcggcctcaagacccgcaagtacacggaggtcaagcccgccctgacaaaaatggtccccgctganaagctcattcgcacccagctcgccagcgccaagtgagcacctttttttgcctttttcgtttccgaggagggcgtcgtcgatgccatttgtttccaataaacagggctccccccctgtgccg

SEQ ID NO: 1279 - DNA, 267 bp, Zea mays
ggggcttcatggattcagtttgatgagcccactcttgtcctcgaccttgattctgacaaattggctgcattctctgctgcatacgcagaacttgaatctgtactttctggattgaatgtgcttgttgagacttactttgctgatgttcctgctgagtcctacaagaccctaacatccctgagcagtgtgactgcttatggttttgatcttgtccgtggaacccaaactcttgggcttgtcacgagtgctggtttccctgctggaaag

SEQ ID NO: 1280 - DNA, 271 bp, Zea mays
  unsure (1)..(271): unsure at all n locations
ctccatgaccgttttctggtcgaagacggcgcagagcatgacgtctcgcccaatgaaggggatgctgactggcccagtcacaatcctcaactggtcttcgtccggaatgaccagccgaggtttganacttgctaccagatcgctcttgcgatcaagaaggaagtcgaggatctcgaggctggtggtatcagttatccaaatcgacgaggctgcatgagagaagggtgccgctccgcaaggctgagcatgcattctattggactgggtgtca

SEQ ID NO: 1281 - DNA, 188 bp, Zea mays
gctggtttccctgctggaaagtacctctttgctggtgttgtggatggacgcaacatctgggctgatgatcttgctacatctctcagcactctccagtctcttgaggctgttgttgggaaggacaagcttgtcgtatcaacttcctgctcgctcatgcacaccgctgtggatcttgtgaacgagactaa

SEQ ID NO: 1282 - DNA, 284 bp, Zea mays
  unsure (1)..(284): unsure at all n locations
gtcgaagagggcgcagagcatgacgtctcgcccaatgaaggggatgctgactggcncagtcacaatcctcaactggtccttcgtccggaatgaccagccgaggtttgagacttgctaccagatcgctcttgcgatcaagaaggaagtcgaggatctcgaggctggtggtattcaggttatccaanttcgacgaggctgcactgagagaagggctgccgctccgnaggntnagnatgattcnaantgggannggggcggccnntcttnnagaatgnnaggnggng

SEQ ID NO: 1283 - DNA, 194 bp, Zea mays
  unsure (1)..(194): unsure at all n locations
cacaaccacaattggtncattccctcagactgtggaactcaggagggttcgccgtgaatacaaggcaaaaagatcaccgaggacgatacntcagtgccatcaaggaanaatcagcaaggttgtcaagatccaagaggagcttgacattgatgtgcttgtgcatggagagccagagaganatgacatggttgagt

SEQ ID NO: 1284 - DNA, 271 bp, Zea mays
cggtgttgataccgtgccagtacttgttggaccagtctcgtacctgttgctctcaaagcccgccaagggtgtggagaagggattccctcttctttcccttcttagcagcatcctcccagtctaaaggaggtcattgctgagttgaaggcagctggggcttcatggattcagtttgatgagcccatcttgtcctcgaccttgattctgacaaattggctgcattctctgctgcatacgcagaacttgaatctgtatttctggattgaatgtg

SEQ ID NO: 1285 - DNA, 209 bp, Zea mays
  unsure (1)..(209): unsure at all n locations
gtgcgtcaagcctccgatcatctacggtgacgtgagccgccccaaccccatgaccgttttctggtcgaagacgggcacagagcatgacgtctcgcccaatgaaagggangctgactggcccagtcacaatcctcaactggtccttcgtccggaatgaccagccgaggtttgagacttgtaccagatcgctcttgcgtcaagaaggaagt

SEQ ID NO: 1286 - DNA, 180 bp, Zea mays
  unsure (1)..(180): unsure at all n locations
cgcagagcatgacgtctcgcccaatgaaggggatgctgactggcccagtcacaatcctcaactggtccttcgtccggaatgaccagccgaggtttgagacttgctaccagatcgctcttgcgatcaagacggaantcgaggntctcnaggctngtggtattcaggttatccaaatcgacg

SEQ ID NO: 1287 - DNA, 200 bp, Zea mays
cacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagcagatggct

SEQ ID NO: 1288 - DNA, 324 bp, Zea mays
  unsure (1)..(324): unsure at all n locations
aatggcgagcctgacanacacgatatggttgantacttcggtgagcagctctccggttttgcnttcactgccaatggctgggtgcagtcttatgggtcaaggtgcgtcaagcctccgatcatctacggtgacgtgagccgccccaaccccatgacgttttctggtcgaagacggcgcagagcatgacgtctcgcncaatgaaggggatgctgactggcccagtcacaatcntcaactggtcttcgtcggaacgaccagccgaggtttgagattgctaccagatcgctcttgcgatnaagaangaatcgangatctgaagctggc

SEQ ID NO: 1289 - DNA, 181 bp, Zea mays
  unsure (1)..(181): unsure at all n locations
aggaaatcctcaccccgtgtgnaccaatgaagaagtccagaaggctgctgctgctctcaagggctctgaccaccgccgtgcgaccaacgttagtgctagattggatgcccagcagaagaagcttaacctccccatccttcccaccactacaatcggttcgttcccacaaaccgttgagctc

SEQ ID NO: 1290 - DNA, 275 bp, Zea mays
  unsure (1)..(275): unsure at all n locations
caccgaggagatcgcagaccgcgtcgagaagatgctcgccgtgctcgacaccaacatcctctgggtgaaccctgactgtggtctcaagacacgcaagtacacggaggtcaagcccgccctgaccaacatggtctcggccaccaagctcatccgcacccagcttgccagcgcgaaatgagtcgtttgatagctccatggtctgatagcgcggaatgagccagtttgttttgaataatttgggtgttaccccctgttccatggtgtnagtgttaggt

SEQ ID NO: 1291 - DNA, 202 bp, Zea mays
  unsure (1)..(202): unsure at all n locations
gctgcatacgcagaacttgaatctgtactttctggattgantgtgcttgttgagacttactttgctgatgttnctgctgagtcctacaagaccctaacatccctgagcagtgtgactgcttatggttttnatcttgtccgtggaacccaaactcttgggcttgtcacgagtgctggtttccctgctggaaagtacctctttg

SEQ ID NO: 1292 - DNA, 181 bp, Zea mays
gagctcaggagggtccgcccgtgagtacaaggcaaaaaagatctctgaggaggaatacgtcactgccatcaaggaggaaatcaacaaggtcgttaagctccaagaagagcttgaacattgatgtgcttgtgctggcgagcctgagagaaacgatatggttgagtacttcggtgagcagctc

SEQ ID NO: 1293 - DNA, 242 bp, Zea mays
  unsure (1)..(242): unsure at all n locations
ccagagcgctactcttggactggaggcgagattggcttgagcacctacttctctatggccaggggaaatgccactgtccctgccatggagatgaccaagtggtttgatacaaactaccactttattgtccctgaacttggcccaagcaccaagttcacatacgctnctcacaaggctgtttctgagtacnnggnggcaaaggggtcggcnttgatncnattcccatgctgttggacannggc

SEQ ID NO: 1294 - DNA, 176 bp, Zea mays
  unsure (1)..(176): unsure at all n locations
acggcgcagagcatggacgtctcgcccaatgaaggggatgctgactggcccagtcacaatcctcaactggtccttcgtccggaatgaccagccgaggtttgagacttgctaccagatngctcttgcgatgaagaaggaagtcgaggatctcgaggctggtggtattcaggttatcc

SEQ ID NO: 1295 - DNA, 228 bp, Zea mays
aagggtgtggagaagggattccctcttctttcccttcttagcagcatcctcccagtctacaaggaggtcattgctgagttgaaggcagctggggcttcatggattcagtttgatgagcccactcttgtcctcgaccttgattctgacaaattggctgcattctctgctgcatacgcagaacttgaatctgtactttctggatgaatgtgcttgttgagactactttgc

SEQ ID NO: 1296 - DNA, 312 bp, Zea mays
  unsure (1)..(312): unsure at all n locations
ccagttcaccacccacctcccactcccagttcaccccgtcgtcctcgngcgccaccactcctgcgtcccccggcgctactcccccgctccacggtccaaggaaagatggcgtcccatattgttggataccctcgcatgggccccaagagggagctcaagtttgccttggagtctttctgggatgggaagagcagcgccgaggatttggagaaagttgccactgacctgaggtctagcatctggaagcaaatgtcagaagtgggatcaagtaattcccagcaatacttctcgtatacgnccaggttttgatac

SEQ ID NO: 1297 - DNA, 270 bp, Zea mays
  unsure (1)..(270): unsure at all n locations
gccaagggtgtggagaagggattccctcttctttccctnctnagcagcatcctcccagtctacaangaggtcattgctgagttgaaggcagctggggctttcatggattcagtttngatgagcccactcttgtcctcgaccttgaatnctgaacaaattggctgcattctctgctggcntacgcagaactngaatctgtactntctggattgaatgtgcttgttgagacttactttgctgatgttcctgctgagtcctacaagaccctaa

SEQ ID NO: 1298 - DNA, 161 bp, Zea mays
gggcgcggggcatcggccccggtgtctacgacatccactcccccaggatcccgtcggccgaggagatcgccgaccgcatcgacaagatgctggccgtgctggacaccaacatcctctgggtgaaccccgactgcggcctcaagacccgcaagtacaggagg

SEQ ID NO: 1299 - DNA, 213 bp, Zea mays
  unsure (1)..(213): unsure at all n locations
tgacagcgagattaagtcttggantgcttttgctgncccagaaggttnntgaggttgatgctcttgctaaggcattggctggtcaaaaggatgaggcttacttcgcagcaaatgctgctgctcaggcctcgaggaaatcctcaccccgtgtgaccaatgaagaagtccagaaggctgctgctgtctcaagggctctgaccaccgccgtgggac

SEQ ID NO: 1300 - DNA, 194 bp, Zea mays
cacctatcatcgccgctgcgccgtctcctccgctcccgtcgtccggaaagatggcgtcccacattgttggataccctcgcatgggccccaagagggagctcaagtttgcacttgagtctttctgggatgggaagagcaccgctgaggatctggagaaggttgctaccgacctcagggccagtatctggaagaaa

SEQ ID NO: 1301 - DNA, 291 bp, Zea mays
  unsure (1)..(291): unsure at all n locations
ctgagcagtgtgactgcttatggttntgatcnngtccgtggaacccaaactcttgggcttgtcacgagtgctggtttccctgctggaaagtacctctnngctggtgttgtggatggacgcaacatctgggctgatgatcttgctacatctctcagcactctccagtctcttgaggctgttgttgggaaggacaagcttgtcgtatcaacttcctgctcgctcatgcacaccgctgtgggagctgtggaaccgagantagcttganaanggggttaagtntnggcttgntnt

SEQ ID NO: 1302 - DNA, 152 bp, Zea mays
tgatgtgcttgtgcatggcgagcctgagagaaacgatatggttgagtacttcggtgagcagctctccggttttgcgttcactgccaatggctgggtgcagtcttatgggtcaaggtgcgtcaagcctccgatcatctacggtgacgtgagcc

SEQ ID NO: 1303 - DNA, 152 bp, Zea mays
  unsure (1)..(152): unsure at all n locations
ggngctgtccactccttcagaattaccaactgcgaganccaggacaccacccagatccanncccacatgtgctactccaacttcaacgacatcatccactcgatcatcgacatggacgcggacgtgatcaccatngagaactcgngggncgg

SEQ ID NO: 1304 - DNA, 468 bp, Zea mays
  unsure (1)..(468): unsure at all n locations
anaacaacnctctctttntaataccngtnccaatacttgttggaccaatctcntacctggngggggnaaaacctancaagggtgnggaaaaagnattccctcttctttcccttcttaacagcatcctcccantctacaaggaggtcattgctganttnaangcanctggggcttnatggattcagtttgatgancccactcttgtcctcgaccttgattctgacaaattggctgcattctcttgctgcatatgcanaacttgaatctgtactttcttggattnaatgtgcttgttnagacttactttgcttatgttcctgctgaantcctacaaaaaccctaacatcccttaaacanngtgaactgcttattggtttttaatcttttcccgnggaacccaaaactnttgggcttntcacnaatgctttggttttccttgcttgaaaaaancnnnctttgttggggtgg

SEQ ID NO: 1305 - DNA, 292 bp, Zea mays
ctggtgttgtggatggacgcaacatctggggctgatgatcttgctacatctctcagcactctccagtctcttgaggctgttgttgggaaggacaagcttgtccgtatcaacttcctgctcgctcatgcacaccgctgtggatcttgtgaacgagactaagcttgacagcgagattaagtcttggctgcttttgctgcccagaaggttgttgaggttgatgctctcgctaaggcattggctggtcaaaaggatgaggcttacttcgcagcaaatgctgctgctcaggcctcga

SEQ ID NO: 1306 - DNA, 414 bp, Zea mays
  unsure (1)..(414): unsure at all n locations
acngcgcgggcatnggccccggtgtctacgacatnnactnccccaggatcccgtcggctgaaggagatcgccgaccgcattgacaagatgctggcggtgctggacaccaacatcctctgggtgaaccccgactgnggnctnaaaaacccgcaagtacacggaggtcaaagccccgncctgaccaacatggtcttccgnccgctaagctcatccgcacccagctngccagcgccaagtgagcaccttttttttgcctttttcgtttccgaggaagggcgtngtcgatgccaatttggtttcaataaacanggctgtgcccgccggtctggtgnactccgctgngggtaaggtaagaagtttcttgancttgncccangccggnactggttactactntntggtngnggttctgag

SEQ ID NO: 1307 - DNA, 163 bp, Zea mays
  unsure (1)..(163): unsure at all n locations
cttcccccggcgctactctcccgctccacgttccaaaggaaagatggcgtcccatattgttggataccctcgcatgggccccaagagagagctcaagtttgccttggagtctttctgggatgggaagagcagcgccgatgatttagagaaagntgnntcggac

SEQ ID NO: 1308 - DNA, 233 bp, Zea mays
caccagttcaccacccacctcccactcccagttcaccccgtcgtcctcggcgccaccactcctcgtcccccggcgctactcccccgctccacggtccaaggaaagatggcgtcccatattgttggataccctcgcatgggccccaagagggagctcaagtttgccttggagtctttctgggatgggaagagcagcgccgaggatttggagaaagttgccactgacctgaggtc

SEQ ID NO: 1309 - DNA, 225 bp, Zea mays
atcaccagttcaccacccacctcccactcccagttcaccccgtcgtcctcggcgccaccactcctcgtcccccggcgctactcccccgctccacggtccaaggaaagatggcgtcccatattgttggataccctcgcatgggccccaagagggagctcaagtttgccttggagtctttctgggatgggaagagcagcgccgaggatttggagaaagttgccactg

SEQ ID NO: 1310 - DNA, 303 bp, Zea mays
  unsure (1)..(303): unsure at all n locations
atcatcaccagttcaccacccacctcccactcccagttcaccccgtcgtcctcggcgccaccactcctcgtcccccggcgctactcccccgctccacggtccaaggaaagatggcgtcccatattgttggataccctcgcatgggccccaagagggagctcaagtttgccttggagtctttctgggatgggaagagcagcgccgaggattggagaaagttgccatgacctgangttanccattggaagcaaatgtcagaantgggatcaagtacatcccagaatacttctcgtatagacaggt

SEQ ID NO: 1311 - DNA, 293 bp, Zea mays
  unsure (1)..(293): unsure at all n locations
gtctacaaggaggtcattgctgagttgaangctgggnggntgctgctaagangggaaagangagggaatcccttcttagcagcatcctcccagtctacnaggnggtcattgctgagttgaaggcagctggggcttcatggattcagtttgatgagcccactcttgtccgcgaccttgattctgacaaattggctgcattctctgctgcatacgcagaacttgaatctgtactttctggattgaatgtgctgttgagactacttgctgatgttcctgctgagtcctacaagacc

SEQ ID NO: 1312 - DNA, 311 bp, Zea mays
  unsure (1)..(311): unsure at all n locations
ccccaaccccatgaccgtttnctggtcgaagacggcacagagcatgacgtctcgcccatgaaggggtgctgactggcccagtcacaatccncaactggtccttcgtccggaatgaccagccgaggtttgagacttgctaccagatcgtcttgcgatcaagaaggaagtcgaggatcttgaggttgtgtattcaggttatccaaatcgagagctgcatgagagaggggtgcgctccgcaagctaagcntcatccacttggnnggtttccattctcggattncangnagatcaaggnacaccngntcacancc

SEQ ID NO: 1313 - DNA, 121 bp, Zea mays
gctgcccagaaggttgttgaggttgatgctcttgctaaggcattggctggtcaaaaggatgaggcttacttcgcagcaaatgctgctgctcaggcctcgaggaaatcctcaccccgtgtga

SEQ ID NO: 1314 - DNA, 222 bp, Zea mays
  unsure (1)..(222): unsure at all n locations
caccagttcaccacccacctcccacncccagttcaccccgtcgtcctcggcgccaccactcctcgtcccccggcgctactcccccgctncacggtccaaggaaagatggcgtcccatattgttggataccctcgcatgggccccaagagggagctcaagtttgccttggagtctttctgggaggggaagagcagtgccgaggattnggagaaattgcnactg

SEQ ID NO: 1315 - DNA, 190 bp, Zea mays
  unsure (1)..(190): unsure at all n locations
ccttgattctgacaaattggctgcatnntctgntgcatacgcagnacttgaatctgtacttnctggattgaatgtgcncgttgagacttacttngctgntgttcctgctgagtccnanaagaccctaacancncngagcagtgtgactgcntatggttttgatcttgtccgtggaacccanactctnggg

SEQ ID NO: 1316 - DNA, 120 bp, Zea mays
gtcccacattgttggataccctcgcatgggccccaagagggagctcaagtttgcacttgagtctttctgggatgggaagaacaccgctgaagatctggagaaggttgctaccgacctcag

SEQ ID NO: 1317 - DNA, 159 bp, Zea mays
  unsure (1)..(159): unsure at all n locations
gcttacttcgcagcanatgctnctgctcatncctcganganatcctcaccccgtntgaccaatgnagaagtccaaaatgctgcngntgcnctcaanggctatgancancgccgngggaccaacgttagtgctagattggatgnccagcagaagaagctt

SEQ ID NO: 1318 - DNA, 288 bp, Zea mays
cgacaccaacatcctctgggtgaaccctgactgtggtctcaagacacgcaagtacacggaggtcaagcccgccctgaccaacatggtctcggccaccaagctcatccgcacccagcttgccagcgcgaaatgaggtcgtttgatagctccatggtctgatagcgcggaatgagccagttgttttgaataatttgggtgttaccccctgttccatggtgttagtgttaggttagcctctcattggtgggatacgccgttacaagatgtgttctaagtttggagtgtgtg

SEQ ID NO: 1319 - DNA, 268 bp, Zea mays
  unsure (1)..(268): unsure at all n locations
cnagcctnnanagnaacgntatggttgagtactttcggtgagcagctctccggttttgcgttccactgccaatggctgggtgcagtcnntatgggtcaaggtgcgtcaagcctccgatcatgctacggtgacgtnagccgcccnaaccccatgaccgttttctcggtcgaagacggcacagagcatgaccgtctcgcccaatgaaggggatgctgactggcccagtcacaatcctncaactggtcccttncgtncggaaatganccac

SEQ ID NO: 1320 - DNA, 118 bp, Zea mays
  unsure (1)..(118): unsure at all n locations
acgacatccactcgcccaggatcccctccaccgaggagatcgcggaccgcgtcaacaagatgctcgcngtgctcgacaccaacatcctctgggtgaaccctgactgcggtctcaagac

SEQ ID NO: 1321 - DNA, 151 bp, Zea mays
gaagcaaatgtcagaagctgggatcaagtacattcccagcaataccttctcgtactacgaccaggttcttgataccacggccatgcttggcgctgtcccagagcgctactcttggactggaggtgagattggctgagcactacttctctat

SEQ ID NO: 1322 - DNA, 436 bp, Zea mays
  unsure (1)..(436): unsure at all n locations
acgacatccactctcctaggattccctccaccgaggagatcgcagaccgcgtcgagaagatgctcgccgtgctcgacaccaacatcctctgggtgaaccctgactgtggtctcaagacacgcaagtcacggaggtcaagcccgccctgaccaacatggtctnggccaccaagcttattccgcacccaacttgncagcgccgaaatgaagtcgtttgatagctcatggtctgatagcgccggaatgagccaagtggtttgnataatttgggtgttaccccctgntccatggngttagtggtaaggtagcctntnattggtgggatacccccgttccagantnggtctaaggttggantgggtggttntctttnggctatggttcttggggtattgtgtgttccttgggtattaacnggaattgaatacccagtcttt

SEQ ID NO: 1323 - DNA, 118 bp, Zea mays
  unsure (1)..(118): unsure at all n locations
tnatcaccattgagnnctcncggtccgacnagaagctgctctccgtnttccgcnaggncgtcaagtacgncncgggcatcngcaccggtntctacnacatccactcccccangatccc

SEQ ID NO: 1324 - DNA, 324 bp, Zea mays
  unsure (1)..(324): unsure at all n locations
cgtgttccgcgagggcgtcaagtacggcgcgggcatcggccccggtgtctacgacatccactcccccaggatcccgtcggctgaggagtcgccgaccgcatcgacaagatgtggcgtgctggacacaacatctctgggtgaaccccgactgcggctcaagaccgcaatacacgagtcaagcccgcctgaccaacatggtctccgccgctaagtcatccgcaccagtcgccagcgccaagtgagcactttttttgcttttcgttcgaggagggtgtgatgcaaattgttcnataaaanggtgtgccgccgttctgttgtatcgtt

SEQ ID NO: 1325 - DNA, 287 bp, Zea mays
ctctgggtgaaccccgactgcggcctcaagacccgcaagtacacggaggtcaagcccgccctgaccaacatggtctccgccgctaagctcatccgcacccagctcgccagcgccaagtgagcaccttttttttgcctttttcgtttccgaggagggcgtcgtcgatgccaatttgtttccaataaacagggctgtgccgccgttctgttgtactccgtctgtggttaggttagtagttttcttgatctcgcccccacgcggtacctgttttactactctctgtttgg

SEQ ID NO: 1326 - DNA, 131 bp, Zea mays
  unsure (1)..(131): unsure at all n locations
gtatgccnagcagaagaagcttaaccnccccatccttcccaccanngacaatcggttcgttcccanaaancgttgagctccaggagggtccgccgtgagtncaaggcaaaaaagatctctgaggaggaata

SEQ ID NO: 1327 - DNA, 155 bp, Zea mays
  unsure (1)..(155): unsure at all n locations
gaagagcttgacattgatgtgcttgtgcatggcgagcctgaganaaacgatatggttgagtacttcggtgagcagctcctccggttttgcgttcactgccaatggctgggtgnagtcttatgggtcaangtgcgtcaagcctccgatcatctacg

SEQ ID NO: 1328 - DNA, 264 bp, Zea mays
  unsure (1)..(264): unsure at all n locations
gacgcgtgggtccacacctatcatcgccgctgcgccgtctcctccgctcccgtcgaccggaaagatgncgtcccacattgttggataccctcgcatgggccccaagagggagctcaagtttgcacttgagtctttctgggatgggaagagcaccgtgaggattggagaaggttgtacgacctcaggcagtattggaacagatgntgatntggataagtacatcccacaacactttgtntatacagtcttgcacatgcantgggt

SEQ ID NO: 1329 - DNA, 270 bp, Zea mays
  unsure (1)..(270): unsure at all n locations
aggaggctaaggngctcggtgttgataccgtgccagtacttgttggaccagtctcgtacctgttgctctncaaagcccgccaagggtgtggagaagggattccctcttcgttcccttcttagcagcatccgcccagtgctanaaggaggtcattgctgagttgaaggcagctggnggcttcatggattcaggttgatgagcccactctngtcctcgnacctggatgctgacaaattgggctgctttntctgctgcatacgagaantggaa

SEQ ID NO: 1330 - DNA, 268 bp, Zea mays
  unsure (1)..(268): unsure at all n locations
ggngtggagaanggattccctcttctttcccttctnagcagcatgcntcccantctanaangaggtcantgctgaggtgaaggcagctggggcttcatggattcagtttgatgancccactcttgtcctcgaccttgattctgacaaattggcctgcattctctgctgcatacgcagaacttgaatctgtactttctggattgantgtgctgtngagannnactttgcnggtgttcctgctgantctacaagaccntntatccntggg

SEQ ID NO: 1331 - DNA, 291 bp, Zea mays
  unsure (1)..(291): unsure at all n locations
ggtgaaccccgactgcggcctcannacccgcaagtacacggaggtcaagcccnccctgaccaacatggtctccgccgctaagctcatccgcacncagctcgccagcgccaagtgagcaccttttttttgcctttttcgtttccgaggaggggtcgtcgatgccaatttgtttccaataaacagggctgtgnccgccgttctgttgtactccgtctgtggttaggttagtanttttcatgatctcgccncacgcggtacctgntttactatctctgtttggnggttnctgag

SEQ ID NO: 1332 - DNA, 128 bp, Zea mays
  unsure (1)..(128): unsure at all n locations
ctncctcctcacctatcatcgccgctgcgccgtctcctccgctcccgtcgnccggaaagatggccgtcccacattgttggataccctcgcatgggccccaagagggagctcaagtttgcacttgagtc

SEQ ID NO: 1333 - DNA, 286 bp, Zea mays
  unsure (1)..(286): unsure at all n locations
cacctatcatcgccgctncnccgtctcctccgctcccgtcgtncggaaanatggngtcccacattgntggatancctcgcatgggccccaaganggagctcaagtttgcacttgagtctttctgggatgggnagagnaccgctgnaggatctgganaaggttgctaccgacntcaagggccagtanctngangccngatgggntgatgctgggatcaagtacatccnccagcaacaaccttgctctacttatgacaaggtccttgacacactgccatgctcgcggt

SEQ ID NO: 1334 - DNA, 156 bp, Zea mays
  unsure (1)..(156): unsure at all n locations
ctacgacatccactctctaggattccctccacagaggagatcgcagaccgcgtcgagaagatgctcgccgtgctncgacaccaacatcctctgggtgaaccctgactgtggtctcaagacacgcaagtacacggaggtcaagcccgccctgaacaa

SEQ ID NO: 1335 - DNA, 185 bp, Zea mays
  unsure (1)..(185): unsure at all n locations
ttnangttgatgctcttgctaaggcattggctggtcaaaaggntgaggcttattcncagcaaatgctgagctcaggcctcgaggaatcctcaccccgtgtgaaccaatgnagaagtccagaaggctgctgctgctctcaagggctctgaccaccgccgtgnaaccaacgttatgctagattggat

SEQ ID NO: 1336 - DNA, 139 bp, Zea mays
  unsure (1)..(139): unsure at all n locations
ggaggttgaggatcttgaggctgctggtattcaggtgatccagnttgatgaggcagctctaaggganngtngccactgcgcaagtcccagagcatgcattctacctggactgngctgtccactctttcagantcaccaa

SEQ ID NO: 1337 - DNA, 114 bp, Zea mays
  unsure (1)..(114): unsure at all n locations
cgaggatcttgaggctggtggtattcaggttatccaaatcgacgaggctgcactgagagaagggctgccgctccgcaaggctgaacatgcatctaactggactgggctgtncca

SEQ ID NO: 1338 - DNA, 254 bp, Zea mays
acggaggtcaagcccgccctgaccaacatggtctccgctgctaagctcattcgcacccagctcgccagcgccaagtgagcacctttttttgcctttttcgtttccgaggagggcgtcgtcgatgccaatttgtttccaataaacagggctccccccctgtgcccgccgttctgttgtgctccgtctgtggttaggttactagttttcttgatctcgcccccacgcggtacctgttttactatctgtttggtggt

SEQ ID NO: 1339 - DNA, 289 bp, Zea mays
cggaggtcaagcccgccctgaccaacatggtctccgccgctaagctcatccgcacccagctcgccagcgccaagtgagcaccttttttttgcctttttcgtttccgaggagggcgtcgtcgatgccaatttgtttccaataaacagggctgtgccgccgttctgttgtactccgtctgtggttaggttagtagttttcttgatctcgcccccacgcggtacctgttttactactctctgtttggtggtttctgaggaagttgcccgtgtattgtatcgtaaaaaccgag

SEQ ID NO: 1340 - DNA, 252 bp, Zea mays
  unsure (1)..(252): unsure at all n locations
cccgactgcggcctacaagacccgcaantacacggaggtcaagcccgccctgaccaacatggtctccgcngctaagctcatcngcacncagctcgccagcgccaagtgngcaccttttttttgcctttttcgtttccgangagggcntcgtngatgccaatttgtttcnantaancagggntgtnccagccgttctgttgnactccgtctgtggttaggttagtagttttcttgatctcgcccccaagcgnt

SEQ ID NO: 1341 - DNA, 79 bp, Zea mays
  unsure (1)..(79): unsure at all n locations
ctgcggagtccaggacaccacccagatccanacccacatgtgtacnccaacttcaacgacntcntcnantccatnanng

SEQ ID NO: 1342 - DNA, 260 bp, Zea mays
  unsure (1)..(260): unsure at all n locations
cggaggtcaagcccgccctgaccaacatggtctccgctgntaagctcattcgcacccagctcgncagcgccaagtgagcacctttttttgcctttttcgtttccgaggagggcgtcgtcgatgccaatttgtttccaataaacagggctccccccctgtgcccgcngttctgttgtgctccgtctgtggttaggttactagttttcttgatctcgcccccacgcggtacctgttttactatctgtttggtggtttctgag

SEQ ID NO: 1343 - DNA, 124 bp, Zea mays
  unsure (1)..(124): unsure at all n locations
caagggctctgcaccaccgccgtgcgaccaacgttagtgctagattggatgcccagcagaagangttaacctccccatccttcccaccantacaatcgggttcgttcccacaaaccgttnagct

SEQ ID NO: 1344 - DNA, 505 bp, Zea mays
  unsure (1)..(505): unsure at all n locations
agnttggtnnagggggggngatnnaaaggcnatctcgtaccggtccggaattcccgggtcgacccacgcgtccggctgaactagagtcggcattctctggattgaatgtgcttattgagacatactntgcngacattcctgctgagtcctacaagaccctcacgtcattgagtggtgtgactgcttacggttttgatcttatccgtggagccaagacccttgatcttatcaggagcagcttcccctctgggaagtacctcttcgctggtgttgtggatggacgcaacatttgggctgatgatcttgctgcatctcttagcactcttcagtctcttgaggccgttgctggcaaggacaaacttgtggtgtcaacctcctgctcactgatgcacaccgccgtgatcttgtaaatgagactaaactggatgaatgaagattaagtcatggcttgcatttgctgcccaaaaggttgtcgaggttaatgcccttgcgaagctttggcaag

SEQ ID NO: 1345 - DNA, 300 bp, Zea mays
  unsure (1)..(300): unsure at all n locations
aaacttgtggtgtcaacntcctgctcactgatgcanaccgctgttgaccttgtaaatgagactaagctggatgatgagattaagtcatggcttgcatttgctgcccaaaaggttgttgaggttaatgcccttgccaaggcnttggcaggccaaaaggatgaggtctactttgcagccaatgctgctgctcaggcctcaaggagatcatcgcccagggtgacaaacgangaggtccagaaggctgcagctgctttgangggatctgaccaccgccgttctaccactgtntctgctagattg

SEQ ID NO: 1346 - DNA, 290 bp, Zea mays
ggacgcaacatttgggctgatgatcttgctgcatctcttagcactcttcattctcttgaggctgttgctggcaaggacaaacttgtggtgtcaacctcctgctcactgatgcacaccgctgttgaccttgtaaatgagactaagctggatgatgagattaagtcatggcttgcatttgctgcccaaaaggttgttgaggttaatgcccttgccaaggctttggcaggccaaaaggatgaggtctactttgcagccaatgctgctgctcaggcctcaaggagatcatcgcc

SEQ ID NO: 1347 - DNA, 259 bp, Zea mays
aacctcctgctcactgatgcacaccgctgttgaccttgtaaatgagactaagctggatgatgagattaagtcatggcttgcatttgctgcccaaaaggttgttgaggttaatgcccttgccaaggctttggcaggccaaaaggatgaggtctactttgcagccaatgctgctgctcaggcctcaaggagatcatcgcccagggtgacaaacgaggaggtccagaaggctgcagctgctttgaggggatctgaccaccgc

SEQ ID NO: 1348 - DNA, 296 bp, Zea mays
  unsure (1)..(296): unsure at all n locations
tgcttatcgagacatacttcgctgatattcctgctgagtcctacaagaccctcacatcattgagtggtgtgactgcttacggtttcgatcttatccgtggagccaagacccttgatcttatcaggagcagcttcccctctgggaagtacctcttcgctggtgttgtagatggacgcaacatttgggctgatgatcttgctgcatctcttagcactcttcattctcttgangctgttgctggcaaggacaaacttgtggtgtcaacctcctgctcactgatgcacaccgctgttgac

SEQ ID NO: 1349 - DNA, 272 bp, Zea mays
cctgctgagtcctacaagaccctcacgtcattgagtggtgtgactgcttacggttttgatcttatccgtggagccaagacccttgatcttatcaggagcagcttcccctctgggaagtacctcttcgctggtgttgtggatggacgcaacatttgggctgatgatcttgctgcatctcttagcactcttcagtctcttgaggccgttgctggcaaggacaaacttgtggtgtcaacctcctgctcactgatgcacaccgctgttgatcttgt

SEQ ID NO: 1350 - DNA, 265 bp, Zea mays
acgtcattgagtggtgtgactgcttacggttttgatcttatccgtggagccaagacccttgatcttatcaggagcagcttcccctctgggaagtacctcttcgctggtgttgtggatggacgcaacatttgggctgatgatcttgctgcatctcttagcactcttcagtctcttgaggccgttgctggcaaggacaaacttgtggtgtcaacctcctgctcactgatgcacaccgctgttgatcttgtcaatgaaactaagctgg

SEQ ID NO: 1351 - DNA, 238 bp, Zea mays
gtagatggacgcaacatttgggctgatgatcttgctgcatctcttagcactcttcattctcttgaggctgttgctggcaaggacaaacttgtggtgtcaacctcctgctcactgatgcacaccgctgttgaccttgtaaatgagactaagctggatgatgagattaagtcatggcttgcatttgctgcccaaaaggttgttgaggttaatgcccttgccaaggctttggcaggccaaa

SEQ ID NO: 1352 - DNA, 226 bp, Zea mays
gatcttgctgcatctcttagcactcttcagtctcttgaggccgttgctggcaaggacaaacttgtggtgtcaacctcctgctcactgatgcacaccgctgttgatcttgtcaatgaaactaagctggatgatgagattaagtcatggcttgcatttgctgcccaaaaggttgtcgaggttaatgcccttgcgaaggctttggcaggccaaaaggatgaggcttact

SEQ ID NO: 1353 - DNA, 248 bp, Zea mays
  unsure (1)..(248): unsure at all n locations
cctgctgagtcctacaagaccctcacntcagggantngtgtgactgcttacggttttgatcttatccgtggagccaagacccttgatcttatcaggagcagcttcccctctgggaagtacctcttcgctggtgttgtggatggacgcaacatttgggctgatgatcttgctgcatctcttagcactcttcagtctcttgaggccgttgctggcaaggacaaacttgtggtgtcaacctcctgctcatg

SEQ ID NO: 1354 - DNA, 203 bp, Zea mays
  unsure (1)..(203): unsure at all n locations
cggacgnttggcgcgagtgctccctcctctgcngccatggcgctctctgtggagangacctcgtctggancngagtacaagttcaaggtctctcncangcggacttcggccgcctcnagattgagctncccnagttcgaaatgcccgncctcatgnctncnccncngattncgcnctttnaaancttnnnnagcgcaaaattc

SEQ ID NO: 1355 - DNA, 96 bp, Zea mays
  unsure (1)..(96): unsure at all n locations
ttgggcttnaaaactnacctngnnttaagcgcattaccattaaaccccaaacnnancgcttggtgtttccccagacnaaaactgngatananntgc

SEQ ID NO: 1356 - DNA, 518 bp, Zea mays
  unsure (1)..(518): unsure at all n locations
aagntctntnnttaaggaggnaaatnnaattnttgtcccggtccggaattcccgggtcgacccacgcgtccgcnnacgcgtncgctnacncgtccgcacangcgtcngcncanncgttcgcccacnacggncgatnnttcnatttcccnatctcgtcanattcaattcgccgagttcttcctctctctgctcgncatggcgctctatgtgganaanacctcgtcatggacgggagtacaaggtcaaggatctatagcangcngacttagntcgccttganattgatctggccnaggncgaaatgcncgnactcatnggntgccncgcccagtttggcccgncnaagccctttggcgntgctaggatctnggnntctctttacatgaccattnacacnggngaagtgattgagacnnttaccgngctcgntgccgaggtncngtggtgatcntncaacatcttattnacacangaccacgcttnaancgnnattggtncgcganttgggtgcanaaatt

SEQ ID NO: 1357 - DNA, 447 bp, Zea mays
  unsure (1)..(447): unsure at all n locations
cggcaagatccccgacccggagtccaccgacaacgctgagttcaagatcgtgctcacnatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgcctcaagcaggctggtgcccgtgtcattgtgaccgagatcgaccccatctgtgcccttcaagctctgatgganggtctttangtcctt

SEQ ID NO: 1358 - DNA, 515 bp, Zea mays
  unsure (1)..(515): unsure at all n locations
gnnnagnnnnnnnannntttgnangggggggggaagaganattttancggtccggattcccgggtcgacccacgcgtccgccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggtaaggttgctgtggtctgcggatacggtgatgtcggcaagggttgtgctgctgccctcaagcaggctggtgcccgtgtcattgtgaccgagatcgaccccatctgtgccctccaggctctgatggaagggtcttcaggtccttcccttggaagacgttgtctctgaactgacatcttcgtgacca

SEQ ID NO: 1359 - DNA, 530 bp, Zea mays
  unsure (1)..(530): unsure at all n locations
ggnnnagggtgntttngtccnaanntntntttnncttctgccngtaccggtccggattcccgggtcgacccacgcgtccgcccacgcgtccgtggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctnagccgactacatnancgtgcccatcgagggtcctac

SEQ ID NO: 1360 - DNA, 501 bp, Zea mays
  unsure (1)..(501): unsure at all n locations
ggnngnnngnaattctaacntncngcagcctgcanaagtccanggtccacccacncgtcgncgaggaggagtacgagaagaccggcaagatccccgacccggagtccaccgacaacgcgagttcaagatcgtgctcaccatcatccgcgacgggctcaaggctgaccccaagaagtacgcaagatgaaggagaggcttgtcggcgtctctgaggagaccaccacgggtgtcaagagctctaccagatgcaggagaccggcgccctcctcttccctgccattaacgtcaacgattcgtcaccaagagcaagtttgacaacctgtatggttgccgccactcactccctgatggtctatgagggccaccgacgttatgatcgccggtaaggttgccgtggtctgcggatacggtgagttggcaagggttgtgccgctgcactcaaancangctgggtgcccgtgtcaantgtgacgaagatttaacccaatctgcgncctccaa

SEQ ID NO: 1361 - DNA, 473 bp, Zea mays
  unsure (1)..(473): unsure at all n locations
cgccggnaaggttgctgtggtctgcggatacggtgatgtcggcaagggttgtgctgctgccctcaagcaggctggngcccgtgtcattgtgaccgagatcgaccccatctgtgccctccangctctgatggagggtcttcangtccttcccttggaggacgttgtctctgaagctgacatcttcgtgaccaccactggcaacaaggatatcatnatggatgaccacatgaggaagatgaagaacaatgccattgtctgcaacattggccactttgacaatgaaattgatatgctcggncttnanacctaccctgncgtcaagcgcatnaccatcaagccccagactgacncgctggntggnccccgagaccaacactgggcatcattgtccttgctgaaggtcggctgatnaaccttgngtgttctactgggcatcctancttttgncatgtctggtcatttactaaaccaag

SEQ ID NO: 1362 - DNA, 524 bp, Zea mays
  unsure (1)..(524): unsure at all n locations
gnnnnngggnggngaatgtctncttngtcgtgccggtccagcgatacaggggccccggacncgtccgggancnatntccccatctcccagatccaattcgcgagttctccctcctctgccgccatggcgctctcngtggagaagacctcgtctggacgggagtacanggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccangaccgccgtcctcatcgagaccctcaccgcgctcggcgccgangtccgctggtgctcctgcaacatcttctccacgcaggaccacgccgccgccgccatcgcgcgcgactcggccgccgtgttcgcctggaanggggaaaccctcgangagtactggtggtgcancgaacgctgcctcgactgggggcgangcggccggcccc

SEQ ID NO: 1363 - DNA, 478 bp, Zea mays
  unsure (1)..(478): unsure at all n locations
gnnnnnngnaacttaagtngcagggccggtcangaataacgggncgacccacgcgtccgttccatttccccatctcccagatccaattcgcgagttctccctcctctgccgccatggcctctctgtggagaagacctcgtctggacgggagtacaaggtcaaggatctctcgcaggcgacttcggccgcctcgagattgagctggccgaggtcgaaatgcccggcctcatggcgtgcgcgccgagttcggcccgtcgaagcccttcgctggcgctaggatctcggggtctctccaatgaccatccagaccgccgtcctcatcgagaccctcaccgcgctcggcgccgangtccgtggtgctcctgcaacatcttctccacgcaggaccacgccgccgccgccatcgcgcgcgatcggccgccgtgttcgcctggaagggggaagacctcgaggagtactggtggtgcaccgacgctgc

SEQ ID NO: 1364 - DNA, 528 bp, Zea mays
  unsure (1)..(528): unsure at all n locations
gnnngnnnngnnnnnnnaaggtnnntgtnnngnaaggagttttatggnatactcgtccgganttcccgggtcgacccacgcgtccgccccatctcccagatccaattcgcgagttctttntcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcacccgagcgctgnctngactggggcnaggcgggccg

SEQ ID NO: 1365 - DNA, 354 bp, Zea mays
  unsure (1)..(354): unsure at all n locations
cgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacnana

SEQ ID NO: 1366 - DNA, 476 bp, Zea mays
  unsure (1)..(476): unsure at all n locations
gggggngnaacttcanntcccagnngccggtcaagaattaacgggtcgacgcncgcgtccggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgaatgganggtcttcaagtccttcccttggaggacgttgtctcctgaagctgncatcttng

SEQ ID NO: 1367 - DNA, 468 bp, Zea mays
  unsure (1)..(468): unsure at all n locations
atcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgcttcccaagcaccttgatgagaaaggtgctgctctcacttggggcaagctttggtgccaagcttaccaaacttaaccaagtcttaaggccgactacattaaccgtgcccgatcgaagggtccctacaagcctgcccactnaccg

SEQ ID NO: 1368 - DNA, 484 bp, Zea mays
  unsure (1)..(484): unsure at all n locations
tttctttgccctggccggtaccanatcanagaattcccgggncgacccacgcatccngctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgcctccanggctctgaatggaaggtcttcangtccttcccttggaaggacgttggtctccgaaagctgacatcttcgtgacnaacaa

SEQ ID NO: 1369 - DNA, 416 bp, Zea mays
  unsure (1)..(416): unsure at all n locations
tgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgccactaccggtactaggcaagccaggcacacggcttgcagctna

SEQ ID NO: 1370 - DNA, 452 bp, Zea mays
  unsure (1)..(452): unsure at all n locations
attgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaaagcttggtgccaagctgaccaagctcaccaagtcttaagccgactacatcagcgtgccgatcganggtccctacaagcctgccactaccggtactangcaagccagcacacggcttgcagcttactcggcccgttgtgtgctatgaagttcct

SEQ ID NO: 1371 - DNA, 481 bp, Zea mays
  unsure (1)..(481): unsure at all n locations
gcaagatgaaggagaggcttgtcggcgtctctgaggagaccaccacgggtgtcaagaggnnctaccagatgcaggagaccggcgccctcctnttccctgccattaacgtcaacgattccgtcaccaagagcaagtttgacaacctgtatggntgccgccactcgctccctgatggtctgatgagggccactgacgttatgatcgccggtaaggntgctgnggtctgcggatacggngatgtcggcaagggttgngctgctgccctcaagcaggctggtgcccgtgtcattgggaccgagatcgaccccatctgngccctccaaggctctgatggagggncttcaggnccttcccttggaggacgnngctntgaaactgacatcttcgggaccaccactggcaacaaggatatcatcangggtgaccacatgaaggaagatgaagaacaaagccaanggcngggaacaatnggccaanttga

SEQ ID NO: 1372 - DNA, 445 bp, Zea mays
  unsure (1)..(445): unsure at all n locations
cgccgtcctcatcgagaccctcaccgcgntcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgcctcgactggggcgaggcgggcggccccgacctcatcgtcgacgacggcggcgacgccacgctgctcatccacgagggtgtcaaggccgaggaggactacgagaagaccggcaagatccccgatccggagtcaccgacaacgctgagttcaagatcgtgctnaccatcattccgcgaanggctnaaagnttaccccaagaagtcccggaaaggataaagaaaagcttgtcggcgtnttttaagagaccacacnggtgtnaaaaggntttacaga

SEQ ID NO: 1373 - DNA, 512 bp, Zea mays
  unsure (1)..(512): unsure at all n locations
ggggttggtgnnnnggtgggnaaattatntgttgtaccggtccggaattcccgggtcgacccacgcgtccgcccacgcgtccgctcacgcgttcgcccanncntccagatncaattcgcgagttctgggntgctctgccgccatggcgctctctgtggagaagacctcgtctggacgggagtacaaggtcaaggatctctcgcaggcggacttcggtcgcctcgagattgagctggccgaggtcgaaatgcccggcctcatggcgtgccgcgccgagttcggcccgtccaagcccttcgccggcgctaggatctcggggtctcttcacatgaccatccagaccgccgtcctcatcgagaccctcaccgcgctcggcgccgaggtccgctggtgctcctgcaacatcttctncacgcaggaccacgccgtcggcggcatcgngcgcgactcggncggcgtgttcgcctggaagggggagaccctttgangagtactggtggtncaccnaaccg

SEQ ID NO: 1374 - DNA, 523 bp, Zea mays
  unsure (1)..(523): unsure at all n locations
agaggctngttttgantggggattaanggnnncttaatggaaagctcttccggnccggcnnccccgctcgacccangcnntncanntnntggagggtcttnaggtcctncncttggaggacgttgtctnngnagctgacngnttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatnaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaaagaangtgtatgtgcttcccaacacctttgatgagaaggt

SEQ ID NO: 1375 - DNA, 441 bp, Zea mays
  unsure (1)..(441): unsure at all n locations
cccagatccaattcgcgagttctccctcctctgccgccatggcgctctctgtggagaagacctcgtctggacnggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcncccgaggtccgctggtgctcctgcaacatcttctncacgcaggaccacnccttcgncngcatcgcgcgcgactcgnccgccgtgttcgcctggaaagggggagnccctcnaggagtactggtggttcaccnagccgcttgccttgnctggggccnaggcngncggncc

SEQ ID NO: 1376 - DNA, 488 bp, Zea mays
  unsure (1)..(488): unsure at all n locations
ggnnnnnnggnaacttnaactnccagcgccaggtaacggtcaaagaattcccgggtcgaccacgcgtccgcggacgcgtgggcccgttccatttccccatctcccagatccaattcgcagttctccctcctctgccgccatggcgctctctgtggagaagacctcgtctggacgggatacaaggtcaaggatctctcgcaggcggacttcggccgcctcgagattgagctggccgagtcgaaatgcccggcctcatggcgtgccgcgccgagttcggcccgtccaagcccttcgcggcgctaggatctcggggtctctccacatgaccatccagaccgccgtcctcatcgagacctcaccgcgctcggcgccgaggtccgctggtgctcctgcaacatcttctccacgcaaggccacgccgccgccgccatcgcgcgcgactcggncgccgtgttcgcctggaagggggagactcgaaggattatggg

SEQ ID NO: 1377 - DNA, 325 bp, Zea mays
caagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcactccctgatggtctgatgagggccaccgacgttatgatcgccggtaaggttgccgtggtctgcggatacggtgatgttggcaagggttgtgccgctgcactcaagcaggctggtgcccgtgtcattgtgaccgagatcgaccccatctgc

SEQ ID NO: 1378 - DNA, 325 bp, Zea mays
gaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtgga

SEQ ID NO: 1379 - DNA, 370 bp, Zea mays
  unsure (1)..(370): unsure at all n locations
gtggtgcaccgagcgctgcctcgactggggcgaggcgggcggccccgacctcatcgtcgacgacggcggcgacgcancgctgctacatccacgagggtgtcaaggaccgaggaggattacgagaagaccggcaagatccccgacccggagtccaccgacaacgctgagttcaagatcgtgctcaccatcatccgcgacgggctcaaggctgaccccaagaagtntcgcaagatgaaggagaggcttgtcggcgtctctgaggagaccaccacgggtgtcaagaggctctaccagatgcaggagaccggcgccctcctcttccctgccattaacgtcaagattccgtcaccaagagcaatttgacaacctg

SEQ ID NO: 1380 - DNA, 329 bp, Zea mays
  unsure (1)..(329): unsure at all n locations
gcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgangaagatgaagaacaatgccattgtc

SEQ ID NO: 1381 - DNA, 346 bp, Zea mays
cacgggtgtcaagaggctctaccagatgcaggagaccggcgccctcctcttccctgccattaacgtcaacgattccgtcaccaagagcaagtttgacaacctgtatggttgccgccactcactccctgatggtctgatgagggccaccgacgttatgatcgccggtaaggttgccgtggtctgcggatacggtgatgttggcaagggttgtgccgctgcactcaagcaggctggtgcccgtgtcatgtgaccgagatcgaccccatctgcgccctccaggctctgatggagggtcttcagtccttcccttggaggacgttgtctcggaagctgacatcttcgtgac

SEQ ID NO: 1382 - DNA, 320 bp, Zea mays
  unsure (1)..(320): unsure at all n locations
ccgagcgctgccttgactggggcgaggcgggcggccccgacctcatcgtcgacgacggcggcgacgccacgctgctcatccacgagggtgtcaaggccgaggaggagtacgagaagaccggcaagatccccgacncggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccatt

SEQ ID NO: 1383 - DNA, 455 bp, Zea mays
  unsure (1)..(455): unsure at all n locations
ctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccggcactcgctccctgatggtctgatgagggccactgacgttatgatcgccggtaaggttgctgtggtctgcggatacngtgatgtcggcaagggttgtgctgctgcctnaaacaggctggtgccccgtgtcattgtgacccagatcgaccccatctgtgcccttcaagcttctgatnganggncttcangtccttcctttggaaggacgttgtntttgnaacttgacatttttngntggaccaccacttgggaacaaggggtnttattattggg

SEQ ID NO: 1384 - DNA, 317 bp, Zea mays
cgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatga

SEQ ID NO: 1385 - DNA, 332 bp, Zea mays
gaacaatgccattgtctgcaacattggccactttgacaatgaaattgatatgctcggccttgagacctaccctggcgtcaagcgcatcaccatcaagccccagactgaccgctgggtgttcccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctcca

SEQ ID NO: 1386 - DNA, 337 bp, Zea mays
cggcgccctcctcttccctgccattaacgtcaacgattccgtcaccaagagcaagtttgacaacctgtatggttgccgccactcactccctgatggtctgatgagggccaccgacgttatgatcgccggtaaggttgccgtggtctgcggatacggtgatgttggcaagggttgtgccgctgcactcaagcaggctggtgcccgtgtcattgtgaccgagatcgaccccatctgcgccctccaggctctgatggagggtcttcaggtccttcccttggaggagttgtctcggaagctgacatcttcgtgaccacccatggcaacaaggatatcatca

SEQ ID NO: 1387 - DNA, 316 bp, Zea mays
  unsure (1)..(316): unsure at all n locations
gtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctganggtcgcctgatgaaccttgggtgtgctactggccatcctagctttgtcatgtc

SEQ ID NO: 1388 - DNA, 315 bp, Zea mays
  unsure (1)..(315): unsure at all n locations
gcgctcggcgccgaggtccgctggtgctcctgcaacatcttctccacgcaggaccacgccgccgccgccatcncgcgcnactcggccgccgtgttcgcctggaagggggagacccttgangagtactggtggtgcaccgagcgctgccttgactggngcgangcgggcggccccnacctcatcgtcgacgacggcggcgacgccacgctgctcatccacgagggtgtcaaggccgaggaggagtacgagaagaccggcaagatccccgacccggagtccaccgacaacgctgagttcaagatcgtggtcaccatc

SEQ ID NO: 1389 - DNA, 310 bp, Zea mays
tctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtc

SEQ ID NO: 1390 - DNA, 457 bp, Zea mays
  unsure (1)..(457): unsure at all n locations
ggggtctctccacatgaccatccagacnngcaagatccccgatccggagtccaccgngnacgctgagttcaagatcgtgctcaccatcatccgcgacgggctcaaggctgaccccaagangtaccgcaagatgaaggagaggcttgtcggcgtctntgaggagaccaccacgggtgtcaagaggctctaccagatgcaggagaccggcgccctcctcttcctgccattaacgtcaacgattccgtcaccaagagcaagtttgacaacctgtatggttgccgncactcgctccctgatggtctgatgaagggccactgaccttatgatcgcccgaaanggtgccgtggtctgcggataccgtgatgtcngcaaagggttgtgcttnttnanttaaancangcttggtggccctgtcantntgaaccananccaancccatntttggnccttcagggtt

SEQ ID NO: 1391 - DNA, 520 bp, Zea mays
  unsure (1)..(520): unsure at all n locations
agttnattnaaggnnggnggntgnaagntatactcgtncggaattcccgggtcgacccacgcgtccgatctcncagacccaattcgngagttctnnntantctgccgacatggcgctctctgtggagaagacctgntctggacgggagtacaaggtcaaggatctctagcaggcggactnaggccgactagagattgagctggccgaggtcgaaatgcccggcctnatggcgtgccgngccgagttcggcccgtncaagcccttngccggcgctaggatctcggggtctctccacatgaccattcagaccgncgtcctcatcgagaccctcaccgcgctcggcgccgaggtccgctggtgctcctgcaacatcnttcttcacgcangaccacgccgncgncgtcatcgcncgcgactcggccggcgtgttcgcctggaanggggagacccttgangagtctggtggtgcaccgnacgcttgcntanntgggccaagcggccggcccgacctattgtngac

SEQ ID NO: 1392 - DNA, 305 bp, Zea mays
cgtcgacgacggcggcgacgccacgctgctcatccacgagggtgtcaaggccgaggaggattacgagaagaccggcaagatctccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagt

SEQ ID NO: 1393 - DNA, 317 bp, Zea mays
  unsure (1)..(317): unsure at all n locations
gtgcccgtgtcattgtgaccgagatcgaccccatctgcnccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattggccactttganaatgaaattgatatgctcggccttgagacctaccctggcgtcaagcgcatcaccatcaagccccagactgaccgctgggtgttccccgagaccaacactggcatcattgtcctt

SEQ ID NO: 1394 - DNA, 309 bp, Zea mays
  unsure (1)..(309): unsure at all n locations
gctgccttgactggggcgaggcgggcggccccgacctcatcgtcgacgacggcggcgacgccacgctgctcatccacgagggtgncaaggccgaggaggagtacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctg

SEQ ID NO: 1395 - DNA, 335 bp, Zea mays
atcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgccca

SEQ ID NO: 1396 - DNA, 334 bp, Zea mays
atcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgccc

SEQ ID NO: 1397 - DNA, 317 bp, Zea mays
aagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgt

SEQ ID NO: 1398 - DNA, 303 bp, Zea mays
catcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgc

SEQ ID NO: 1399 - DNA, 311 bp, Zea mays
  unsure (1)..(311): unsure at all n locations
agcaggctggtgcccgtgtcattgtgaccgagatcgaccccatctgcnccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattggccactttgacaatgaaattgatatnctcggccttgagacctaccctggcgtcaagcgcatcaccatcaagccccagactgaccgctgggtgttccccgagaccaacact

SEQ ID NO: 1400 - DNA, 308 bp, Zea mays
  unsure (1)..(308): unsure at all n locations
caaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggngttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctg

SEQ ID NO: 1401 - DNA, 309 bp, Zea mays
ggctggtgcccgtgtcattgtgaccgagatcgaccccatctgcgccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactgg

SEQ ID NO: 1402 - DNA, 311 bp, Zea mays
cttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgccaacttgaactgtg

SEQ ID NO: 1403 - DNA, 338 bp, Zea mays
  unsure (1)..(338): unsure at all n locations
gtttgacaacctgtatggttgccgccactcgctccctgatggtctgatgagggccactgacgttatgatcgccggaaangttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcaggttgaccacatgangaagatgaagaacaatgccatgtctgcaacatggccant

SEQ ID NO: 1404 - DNA, 306 bp, Zea mays
ggagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagct

SEQ ID NO: 1405 - DNA, 424 bp, Zea mays
  unsure (1)..(424): unsure at all n locations
anangctncngcggtctcctgntacaanagannnnnnnaanggttgngctnatgccgtnaancaanntgangcccgagtcattgtnaccgagatcgaccccatctgtgccctncaggctctgatggagggtcttcaggtccttcccttgnaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctgncgtcaagcgcatcaccatcaagccccagactgaccgctgggtgttccccgagaccaacacttggcattcattgtccttgctgaaggtcnccctgattaacctttggttgtgcta

SEQ ID NO: 1406 - DNA, 299 bp, Zea mays
gtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgt

SEQ ID NO: 1407 - DNA, 299 bp, Zea mays
  unsure (1)..(299): unsure at all n locations
gcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcnactcggccgccgtgttcgcctggnagggggagaccctcgaggagtactggtggtgcaccgagcgctgcctcgactggngcgangcgggcggncccgacctcatcgtcgacgacggcggcgacgccacgctgctc

SEQ ID NO: 1408 - DNA, 303 bp, Zea mays
  unsure (1)..(303): unsure at all n locations
cacgcaggaccacgccgccgccgccatcgcgcgcgactcggccgccgtgttcgcctggnagggggagacccttgaggagtactggtggtgcaccgagcgctgccttgactggggcgaggcgggcggccccgacctcatcgtcgacgacggcggcgacgccacgctgctcatccacgagggtgtcaaggccgaggaggagtacgagaagaccggcaagatccccgacccggagtccaccgacaacgctgagttcaagatcgtgctcaccatcatccgcgacgggctcaaggctgaccccaagaa

SEQ ID NO: 1409 - DNA, 494 bp, Zea mays
  unsure (1)..(494): unsure at all n locations
gggttngngaaattcctacgntctcggnatcggtcntnaattcacgggtcgacccacgctccanttacaattccncatctcccatgattcaatttcgcgaagttctccctcctctgccccatggcgctctctgtgganaagacctcgtctggacgggagtacaaggtcaaggatctccgcangcggacttcggncgcctcgagattgagctggccgaggtcgaaatgcccggcctctggcgttgccgcgccgagttcggcccgtcnaagcccttcgctggcgctaggatctcgggtctctccacatgaccatccaaaccgccgtcctcatcgagaccctcaccgcgctcggcgcgaggtccgctggtgctcctgcaacatcttctccacgcangaccacgccgccgccgccatgcgcgcgactcggccgccgntgttcnccctggaangggggaaaacctccaagaantactgtggttcaancgagccgctgnt

SEQ ID NO: 1410 - DNA, 299 bp, Zea mays
  unsure (1)..(299): unsure at all n locations
cngggtctcnccacatgaccatccagaccgccgtcctcatcgagaccctcaccgcgctcggcgccgaggtccgcnggtgcncctgcaacancttcnccacgcaggaccacgccgcngccgccatcgcgcgcgantcggccgcngtgtncgcctggaagggggagaccctcgangagtactggnggtgcaccgagcgctgcctcgactggngcgangcgggcggccccgacctcatcgtcgacgacggcggcgacgccacgctgctcatccacgagggtgtcaangccgaggaggattac

SEQ ID NO: 1411 - DNA, 302 bp, Zea mays
  unsure (1)..(302): unsure at all n locations
cgtcgacnacggcggcgacgccacgctgctcatccacgagggtgtcaaggccgangaggattacgagaagaccggcaagatctccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcagganaccggcgccctcctcttccctgccattaacgtcnacgattccgtcaccaagagca

SEQ ID NO: 1412 - DNA, 485 bp, Zea mays
  unsure (1)..(485): unsure at all n locations
ccatttccccatctcccagatccaattcncnagttcttcctcctctgccgccatggcgctntntgtggagaagacctcgtctggacgggagtacaaggtcaaggatctctcgcaggcggacttcggtcgcctcgagattgagctggccgaggtcgaaatgcccggcctcatggcgtgccgcgccgagttcggcccgtccaagcccttcgccggcgctaggatctcggggtctcttcacatgaccatccagaccgncgtcctcatcgagaccctcaccgngctcggcgccgaggtccgctggtgctctgcaacatcttnttcacgcaaggacacgccgncggccgncatcgcgcgcgactcggccggcgngttcgcctggaaagggggagaccctttgaggagtactggtggtgcaccgagccgcttgncttganttggggccaggcngggcggcccgaacctnaatggtngacaacnggggggaa

SEQ ID NO: 1413 - DNA, 311 bp, Zea mays
atcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgat

SEQ ID NO: 1414 - DNA, 311 bp, Zea mays
  unsure (1)..(311): unsure at all n locations
tctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctganggtctgatgagggccactgacgttatgatcgccggaaaggttgcngtggtntgcggatacggtgatgtcggcaagggttgtgctgctgccctcaagcaggctggtgcccgtgtcattgtgaccganatcnaccccatctgtgnctccaggctctgatggagggtctt

SEQ ID NO: 1415 - DNA, 280 bp, Zea mays
  unsure (1)..(280): unsure at all n locations
cncgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtcc

SEQ ID NO: 1416 - DNA, 295 bp, Zea mays
gagatcgaccccatctgcgccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtcc

SEQ ID NO: 1417 - DNA, 349 bp, Zea mays
  unsure (1)..(349): unsure at all n locations
ctggcgtcaagcgcatcaccatcaagcnccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctggaccaagctcaccaagtctcaggccgatacatcagcgtgccgatcgnggtcctacaagcctg

SEQ ID NO: 1418 - DNA, 292 bp, Zea mays
ctgatgagggccaccgacgttatgatcgccggtaaggttgccgtggtctgcggatacggtgatgttggcaagggttgtgccgctgcactcaagcaggctggtgcccgtgtcattgtgaccgagatcgaccccatctgcgccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattg

SEQ ID NO: 1419 - DNA, 287 bp, Zea mays
agaggctctaccagatgcaggagaccggcgccctcctcttccctgccattaacgtcaacgattccgtcaccaagagcaagtttgacaacctgtatggttgccgccactcactccctgatggtctgatgagggccaccgacgttatgatcgccggtaaggttgccgtggtctgcggatacggtgatgttggcaagggttgtgccgctgcactcaagcaggctggtgcccgtgtcattgtgaccgagatcgaccccatctgcgccctccaggctctgatggagggtctt

SEQ ID NO: 1420 - DNA, 304 bp, Zea mays
  unsure (1)..(304): unsure at all n locations
gtgcnctccangctctgatggagggtcttcaggtccttcncttggangacgttgtctctgaagctgacatcttcgtgaccaccactggcaacaangatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcatgtcttgctganggtcgcctgatgaaccttg

SEQ ID NO: 1421 - DNA, 283 bp, Zea mays
  unsure (1)..(283): unsure at all n locations
ggagtactggtggtgcaccgagcgctgcctcgactggggcgaggcgggcggccccgacctcatcgtcgacgacggcggcgacgccacgctgctcatccacgagggtgtcaaggccgaggaggattacnagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggt

SEQ ID NO: 1422 - DNA, 420 bp, Zea mays
  unsure (1)..(420): unsure at all n locations
ggatatgctccgggcttgagacctaccctggcgtcaagcgcatnaccatcaagccccagactgaccgctgggtgttccccgagaccaacactggcatcattgnccttgctgagggtcgcctgatgaaccttgggtgtgctactggccatnctagctttgtcatgtcctgctcattcactaaccaggtcattgcccaacttgaactgtggaaggagaagagctctggcaagtatnanaagaangtgtatgtgctncccaagcaccttgatnagaangntgntgntctncacttgggcaagcttggtgccaanctnaccaagcttaccaaagtcttaagnccgctacnttaacctgcccntcgaaggntccttccaacctnnccacnaaccggtcttagnaagcnnnacaacggttngaant

SEQ ID NO: 1423 - DNA, 311 bp, Zea mays
  unsure (1)..(311): unsure at all n locations
gaccggcgccctcctcttccctgccattaacgtcaacgattccntcaccaagancaagtttgacaacctgtatggttncngccactcgctccctgatggtctgatgagggccactgacgttatgatcgccggaaaggttgccgtggtctgcngatacggtgatgtcggcaaggnttgtgctgctgccctcaagcaggctggtgcccgtgtcattgtgaccganatcgaccccatctnttccctccaggctctgatggagggtcttcaggtccttcccttggaagacgttgtctctgaagctgacatcttcg

SEQ ID NO: 1424 - DNA, 283 bp, Zea mays
cgacgccacgctgctcatccacgagggtgtcaaggccgaggaggagtacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaag

SEQ ID NO: 1425 - DNA, 369 bp, Zea mays
  unsure (1)..(369): unsure at all n locations
aattccntcacnaaaagcaagtttganaacctgtatggttgccgcnanncactccctgatggnctgatnagggccaccgacgttatgatcgccggtaaggttgccgtggnctgcngataccgtgatgttggcaanggttgtgccnctgcactcaagcaggctgntgcccgtgtcattgtgaccgagatcgannccatctgcgccctccacgctctgatggatgggtcttcaagtccttcccttggaggacgttgtctcgggaagctgacatcttcgtgaccaccactggcaacaaggatatcatcaatgggttgancacatgaaggaacgatgaaggacaatggcantgtctgcaacattgggcaacnt

SEQ ID NO: 1426 - DNA, 278 bp, Zea mays
gcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatg

SEQ ID NO: 1427 - DNA, 275 bp, Zea mays
cttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgct

SEQ ID NO: 1428 - DNA, 275 bp, Zea mays
tgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgt

SEQ ID NO: 1429 - DNA, 294 bp, Zea mays
caccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggc

SEQ ID NO: 1430 - DNA, 276 bp, Zea mays
gctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatg

SEQ ID NO: 1431 - DNA, 288 bp, Zea mays
  unsure (1)..(288): unsure at all n locations
ctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggnaaggggagacccttgaggagtactggtggtgcaccgagcgctgccttgactggggcgangcgggcggccccgac

SEQ ID NO: 1432 - DNA, 285 bp, Zea mays
tgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggtcttcaggtccttccct

SEQ ID NO: 1433 - DNA, 280 bp, Zea mays
atcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactg

SEQ ID NO: 1434 - DNA, 316 bp, Zea mays
  unsure (1)..(316): unsure at all n locations
cgaccccatctgcnccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcatgtccttgctgaaggtcgcctgatgaacttgg

SEQ ID NO: 1435 - DNA, 298 bp, Zea mays
  unsure (1)..(298): unsure at all n locations
gcccggcctcatggcgtgccgcgccgagttcggcccgtccaagcccntcgccggcgctaggatctcggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaaagggggagaccctcgaggagtactggtggtgcaccgagcgctgctcgactggggcgaagcgggcggcccgacctca

SEQ ID NO: 1436 - DNA, 299 bp, Zea mays
  unsure (1)..(299): unsure at all n locations
agaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaactgtatggttgccgcanttcgttccttgatggtttgatgagggccactgang

SEQ ID NO: 1437 - DNA, 279 bp, Zea mays
gtcaaggccgaggaggagtacgagaagaccggcaagatccccgacccggagtccaccgacaacgctgagttcaagatcgtgctcaccatcatccgcgacgggctcaaggctgaccccaagaagtaccgcaagatgaaggagaggcttgtcgggcgtctctgaggagaccaccacgggtgtcaagaggctctaccagatgcaggagaccggcgccctcctcttccctgccattaacgtcaacgattccgtcaccaagagcaagtttgacaacctgtatgg

SEQ ID NO: 1438 - DNA, 277 bp, Zea mays
gcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaactgtatggttgccgccactcgctccctgatggtctgatg

SEQ ID NO: 1439 - DNA, 318 bp, Zea mays
atttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaacatcttct

SEQ ID NO: 1440 - DNA, 249 bp, Zea mays
cacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagaccctcgaggagtactggtggtgcaccgagcgctgcctcgactggggcgaggcgggcggccccgacctcatcgtcgacgacggcggcgacgccacg

SEQ ID NO: 1441 - DNA, 309 bp, Zea mays
  unsure (1)..(309): unsure at all n locations
cccagatccaattcgcgagtncnccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctnaccgcgctcggcgccgaggtccgctggtgctcctgcaacatcttctcca

SEQ ID NO: 1442 - DNA, 276 bp, Zea mays
gtacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcact

SEQ ID NO: 1443 - DNA, 276 bp, Zea mays
  unsure (1)..(276): unsure at all n locations
gtgaccganatcgaccccatctgtnccctccaggctctgatggagggtcttcaggtccttcccttggaggacgttgtctctgaagctgacatnttcgtgaccaccactggcaacaaggatatcatcatggttgaccacatgaggaagatgaagaacaatgccattgtctgcaacattggccactntgacaatgaaattgatatgctcggccttgagacctaccctggcgtcaagcgcatcaccatcaagccccagactgaccgctgggtgttcccc

SEQ ID NO: 1444 - DNA, 270 bp, Zea mays
agaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgc

SEQ ID NO: 1445 - DNA, 261 bp, Zea mays
ggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaacct

SEQ ID NO: 1446 - DNA, 291 bp, Zea mays
  unsure (1)..(291): unsure at all n locations
tntgacaacctgtatggttgccgccactcgctccctgatggtctgatgagggccactgacgttatgatcgccggaaaggttgccgtggtcanncggatacggtgatgtcggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttga

SEQ ID NO: 1447 - DNA, 316 bp, Zea mays
  unsure (1)..(316): unsure at all n locations
actggggcgaggcgggcggccccgacctcatcgtcgacgacggcggcgacgccacgctgctcatccacgagggtgtcaaggccgaggaggagtacgagaagaccggcaagatccccgacccggagtccaccgacaacgctgagttcaagatcgtgctcaccatcatccgcgacgggctcaaggctgaccccaagaagtaccgcaagatgaaggagagcttgtcggcgtcttaaggagaccaccagggtgtcaagaagctctaccagatgcaagaaaccggcgccctcctcttccctgccattaacgtnacgatccg

SEQ ID NO: 1448 - DNA, 273 bp, Zea mays
  unsure (1)..(273): unsure at all n locations
cncgacctcatcgtcgacgacggcggcgacgccacgctgctcatccacgagggtgtcaaggccgaggaggagtacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtncaagaggctctaccagatgcaggagaccggcgccctcct

SEQ ID NO: 1449 - DNA, 271 bp, Zea mays
  unsure (1)..(271): unsure at all n locations
cngacgctgggtggctcctgcaacatcttctccacgcaggaccacgccgccgccgccatcgcgcgcgacacggccgccgtgttcgcctggaagggggagaccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaagatccccgacccggagtccaccg

SEQ ID NO: 1450 - DNA, 275 bp, Zea mays
  unsure (1)..(275): unsure at all n locations
aacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgcccgtgtcattgtgaccgagatcgaccccatctgtgccctccaggctctgatggagggttncaaggtcctncccttggaggacgttgtctcngaagatgacatctt

SEQ ID NO: 1451 - DNA, 271 bp, Zea mays
gagatcgaccccatctgcgccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccg

SEQ ID NO: 1452 - DNA, 277 bp, Zea mays
cattaacgtcaacgattccgtcaccaagagcaagtttgacaacctgtatggttgccgccactcactccctgatggtctgatgagggccaccgacgttatgatcgccggtaaggttgccgtggtctgcggatacggtgatgttggcaagggttgtgccgctgcactcaagcaggctggtgcccgtgtcattgtgaccgagatcgaccccatctgcgccctccaggctctgatggagggtcttcaggtccttcccttggaggacgttgtctcggaactg

SEQ ID NO: 1453 - DNA, 273 bp, Zea mays
ctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttggg

SEQ ID NO: 1454 - DNA, 299 bp, Zea mays
  unsure (1)..(299): unsure at all n locations
ggagggtcttcaggtccttcccttggaggacgttgtctctgaagctgacatcttcgtgaccaccactggcaacaaggatatcatcatggttgaccacatgaggaagatgaagaacaatgcnatgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgctgatgaacttgggtgtgtatggccac

SEQ ID NO: 1455 - DNA, 282 bp, Zea mays
  unsure (1)..(282): unsure at all n locations
ccgccactcgctccctgatggtctgatgagggccactgacgttatgatcgccggaaaggttgccgtggtctgcggatacggtgatgtcnngcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgagga

SEQ ID NO: 1456 - DNA, 297 bp, Zea mays
  unsure (1)..(297): unsure at all n locations
ggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatganggccactgacgttatgattcgccggaaaggttgccgtggtctgcggatacggtgatgtcggcaanggttgtgtgctgccctcaagcangctgg

SEQ ID NO: 1457 - DNA, 130 bp, Zea mays
  unsure (1)..(130): unsure at all n locations
gngatcgaccccatctgcgccctccagnctctnatggagggtcttcaggtccttcccttgnaggacgttgtctcggaagctgacatcttcggtgaccaccactggcaacaaggatatcanncatgggttg

SEQ ID NO: 1458 - DNA, 304 bp, Zea mays
catctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgcaac

SEQ ID NO: 1459 - DNA, 512 bp, Zea mays
  unsure (1)..(512): unsure at all n locations
gnggnnnnngagtgnntnntaatttggaggnaaaatgtaanggnaatcttcgtaccggtccggaannntcgacccacgcgtccgcccacgcgtccggaccaacactggcatcattgtccttgctgagggtcgnctgatgancctggggtgtgctactggccatcctagctttgncatgtcctgctcattcactaaccaggtcattgcccaacttgaactgtggaaggagaagagctctggcaagtatgaaaagaaggtgtatgtnctccccaagcaccttgatgagaaggttgctgctctccacttgggcaancttggtgccaagctgaccaagctnaccaagtctcaggccgactacatcagcgtgccgatcgagggtccctacaagcctgccactaccggtactaggcagccagcacacggnttgcaactnactcgggccgtgtgtgctatnaagccgctcactggcctgnagntatctnncgnannctatggcataaacatanacggga

SEQ ID NO: 1460 - DNA, 263 bp, Zea mays
  unsure (1)..(263): unsure at all n locations
gccacgcaggaccacgccgccgccgccatcgcgcgcgactcggccgccgtgttcgcctgnaanggggagacccttgaggagtactggtggtgnaccgagcgctgccttgactggggcgaggcgggcggccccgacctcatcgtcgacgacggcggcgacgccacgctgctcatccacgagggtgtcaaggccgaggaggagtacgagaagaccggcaagatccccgacccggagtccaccgacaacgctgagttcaagatcgt

SEQ ID NO: 1461 - DNA, 247 bp, Zea mays
ggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaagggggagacccttgaggagtactggtggtgcaccgagcgctgccttgactggggcgaggcgggcggccccgacctcatcgtcgacgacggcgg

SEQ ID NO: 1462 - DNA, 260 bp, Zea mays
ggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactg

SEQ ID NO: 1463 - DNA, 272 bp, Zea mays
  unsure (1)..(272): unsure at all n locations
ggccaccgacgttatgatcgccggtaaggttgccgtggtctgcggatacggtgatgttggcaagggttgtgccgctgcactcaagcaggctggtgcccgtgtcattgtgaccgagatcgaccccatctgcgccctccaggctctgatggagggtcttcaggtccttcccttggaggacgttgtctcggaagctgacatcttcgtgaccaccactggcaacaaggatatcatcanggttgaccacatgaggaagatgangaacaatgccattg

SEQ ID NO: 1464 - DNA, 253 bp, Zea mays
ggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccag

SEQ ID NO: 1465 - DNA, 261 bp, Zea mays
ccacgctgctcatccacgagggtgtcaaggccgaggaggagtacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtca

SEQ ID NO: 1466 - DNA, 261 bp, Zea mays
cggggtctctccacatgaccatccagaccgccgtcctcatcgagaccctcaccgcgctcggcgccgaggtccgctggtgctcctgcaacatcttctccacgcaggaccacgccgccgccgccatcgcgcgcgactcggccgccgtgttcgcctggaaggggagacccttgaggagtactggtggtgcaccgagcgctgccttgactggggcgaggcgggcggccccgacctcatcgtcgacgacggcggcgacgcacgctg

SEQ ID NO: 1467 - DNA, 323 bp, Zea mays
ctcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccgccgctaggatctcggggtctctccacatgaccatccagaccgccgtcctcatcgagaccctcaccgcgctcggcgccgaggtccgcaggtgctcctgcaacat

SEQ ID NO: 1468 - DNA, 277 bp, Zea mays
  unsure (1)..(277): unsure at all n locations
gctcggccttgnagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgc

SEQ ID NO: 1469 - DNA, 257 bp, Zea mays
caaggatatcatcatggttgaccacatgaggaagatgaagaacaatgccattgtctgcaacattggccactttgaacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctca

SEQ ID NO: 1470 - DNA, 262 bp, Zea mays
gtcggcgtctctgaggagaccaccacgggtgtcaagaggctctaccagatgcaggagaccggcgccctcctcttccctggccattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgcactcaagcaggctggtgcc

SEQ ID NO: 1471 - DNA, 317 bp, Zea mays
  unsure (1)..(317): unsure at all n locations
tatggttgccgccactcactccctgatggtctgatgagggccaccgacgttatgatcgccggtaaggttgccgtggtctgcggatacggtgatgttggcaagggttgtgccgctgcactcaagcaggctggtgcccgtgtcattgtgaccgagatcgaccccatctgcnccctccaggctctgatggagggtcttcaggtccttcccttggaggnntngtcacggaagctnanatttcgtgaccaccactggnaacaaggatatcatcatggttgaccacatgaggaagatgaanaacatgccattgtctcnaattg

SEQ ID NO: 1472 - DNA, 268 bp, Zea mays
cgactggggcgaggcgggcggccccgacctcatcgtcgacgacggcggcgacgccaacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctcta

SEQ ID NO: 1473 - DNA, 274 bp, Zea mays
ggcaagggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccatttgacaatgaaattgatatgctcggccttgagacctaccctgg

SEQ ID NO: 1474 - DNA, 290 bp, Zea mays
gttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagactacctggcgtcaagcgcatcacatcaagccc

SEQ ID NO: 1475 - DNA, 300 bp, Zea mays
  unsure (1)..(300): unsure at all n locations
cgagggtgtcaaggccgaggaggagtacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattcgtcaccagagcaagtttgacnactgtatggttgccgcaattcattccc

SEQ ID NO: 1476 - DNA, 260 bp, Zea mays
  unsure (1)..(260): unsure at all n locations
anggtcttcaggtccttcccttggaggacgttgtctcggaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtcctt

SEQ ID NO: 1477 - DNA, 295 bp, Zea mays
  unsure (1)..(295): unsure at all n locations
attacnagaagaccggcaaganccccgacccggagtccaccgacaacgctgagttcaagatcgtgctcaccatcatccgcnacgggctcaaggctgaccccaagaagtaccgcaagangaaggacgaggcttgtcggcgtctctgaggagaccaccacgggtgtcaagaggctctaccagatgcaggagaccggcgccctcctcttccctgccattaacgtcaangattccgtcaccaagagcaagtttgacaacntgtatggttgccgccaactcggctccctgatggtctgat

SEQ ID NO: 1478 - DNA, 278 bp, Zea mays
  unsure (1)..(278): unsure at all n locations
gncgcngccgccatcgcgcgcgactcggccgccgtgttcgcctggaagggggagacccttgaggagtactggtggtgcaccgagcgctgccttgactggggcgaggcgggcggccccgacctcatcgtcgacgacggcggcgacgccaacgctgctcatccacgagggtgtcaaggccgaggaggagtacgagaagaccggcaagatccccgacccggagtccaaccgacaacgntgagttcaagatcgtgcttaccatcattcgggacnggctcaaa

SEQ ID NO: 1479 - DNA, 287 bp, Zea mays
gctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtacta

SEQ ID NO: 1480 - DNA, 306 bp, Zea mays
  unsure (1)..(306): unsure at all n locations
cgtcaccaagagcaagtttgacaacctgtatggttgccgccatcgctccctgatggtctgaatgagggccactgacgttatgatcgccggaaaggttgccgtggtctgcggatacggtgatntcggcaanggttgtgctgctgccctcaagcaggctggtgcccgtgtcattgtgaccgagatcgaccccatctgtgccctccaggctctgatggagggtcttcaggtccttcccttggaggacgttgtctctgaagctgacatcttcgtgaccaccactggcaacaaggatatcacatggttgac

SEQ ID NO: 1481 - DNA, 314 bp, Zea mays
  unsure (1)..(314): unsure at all n locations
ctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctganggtcgcctgatgaacttgggtgtgtatggccatcctagtttgtcatgtcctgtcatnactaaccagtcattgnccaattgaa

SEQ ID NO: 1482 - DNA, 270 bp, Zea mays
atgccattgtctgcaacattggccactttgacaatgaaattgatatgctcggccttgagacctaccctggcgtcaagcgcatcaccatacaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaag

SEQ ID NO: 1483 - DNA, 266 bp, Zea mays
  unsure (1)..(266): unsure at all n locations
caccgacgttatgatcgccggtaaggttgccgtggtctgcggatacggtgatgttggcaaggnttgtgccgctgcactcaagcaggctggtgcccgtntcattgtgaccgagatcgaccccatctgcnncctccangctctgatggagggtcttcaggtccttcccttggaggacgttgtctcggaagctgacatcttcgtgaccaccactggcaacaaggatatcatcatggttgaccacatgaggaagatgaagaacaatgcca

SEQ ID NO: 1484 - DNA, 312 bp, Zea mays
  unsure (1)..(312): unsure at all n locations
ctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgncgagttcggcccgtccaagcccttcgccggcgctaggatctcggggtctctccacatgaccatccagaccgccgtcctcatcgagaccctcaccgcgctcggcgccgaggtccgctggtgctc

SEQ ID NO: 1485 - DNA, 271 bp, Zea mays
aagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgaaagaaggtgtatgtgctccccaagcaccttgatgagaaggttgctgctctccacttgggcaagcttggtgccaagctgaccaagct

SEQ ID NO: 1486 - DNA, 275 bp, Zea mays
actggggcgaggcgggcggccccgacctcatcgtcgacgacggcggcgacgccaacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggtctaccagatgcag

SEQ ID NO: 1487 - DNA, 407 bp, Zea mays
  unsure (1)..(407): unsure at all n locations
gtccttgctgagggtcgcctgatgaaccttgggtggggctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctnactcgggccgttgtgtgctatgaagttcgctacactggcctgtcaattatcttttgcatgcatatgcattatcatatacccaagtcgcgtacag

SEQ ID NO: 1488 - DNA, 300 bp, Zea mays
  unsure (1)..(300): unsure at all n locations
ctcccagatccaattcgcgagttctccctcctctgccgccatggcgctctctgtggagaagacctncgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgctggtgctcctgca

SEQ ID NO: 1489 - DNA, 259 bp, Zea mays
  unsure (1)..(259): unsure at all n locations
ccgctgcactcaagcaggctggtgcccgtgtcattgtgaccgagatcgaccccatctncgccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattggccactttgacaatgaaattgatatgctcggccttgagacctaccc

SEQ ID NO: 1490 - DNA, 303 bp, Zea mays
  unsure (1)..(303): unsure at all n locations
gagggccaccgacgttatgatcgccggtaaggttgccgnggtctgcggntacggtgatgttggcaagggttgtgccgctgcactacaagcaggctggtgcccgtgtcattgtgaccgagnatcgaccccatctgcgccctccaggctctgatggagggtcttcaggtccttcccttggaggacgttgtctcggaagctgacatcttcgtgaccaccactggcaacaaggatatcatcatggttgaccacatgaggaagatgaagaacaatgccatgtctgcaacntggccatttgacangaat

SEQ ID NO: 1491 - DNA, 268 bp, Zea mays
  unsure (1)..(268): unsure at all n locations
gtcgacgacggcggcgacgccaacgctgctcatccacgagggtgtcaaggccgaggaggagtacgagaagaccggcaagatccccgacccggagtccaccgacaacgctgagttcaagatcgtgctcaccatcatccgcgacgggctcaaggctgaccccaagaagtaccgcaagatgaaggagangcttgtcggcgtctttgaggagaccaccangggtgtcaagaggtctaccagatgcaggagaccggcgccctcctcttccctg

SEQ ID NO: 1492 - DNA, 278 bp, Zea mays
  unsure (1)..(278): unsure at all n locations
gttctagatcgcgagctagaactagcaccacgggtgtcaagaggctctaccagatgcaggagaccggcgccctcctcttccctgncattaacgtcaacgattccgtcaccaagagcaagtttgacaacctgtatggttgccgccactcgctccctgatggtctgatgagggccactgacgttatgatcgccggaaaggttgccgtggtctgcggatacggtgatgtcggcaagggttgtgctgctgccctcaagcaggctggtgccgtgtcatgtgac

SEQ ID NO: 1493 - DNA, 282 bp, Zea mays
  unsure (1)..(282): unsure at all n locations
gctcgnncttgannnctacccnggngtcaagngcatcnncatcangccccagactgancgctgggnnttccccnanaccaacactggcatcantgtccttgctganggtcgcctgatgaaccttnggtgtgcnactggccatcctagctttgtcangtnctgctcattcactaaccaggtcattgcccaacttgaactgtggaaggagaagagctctggcaagtatgagaagaaggtgtatgtgctccccaagcaccttgatgagaaggttgctganctcca

SEQ ID NO: 1494 - DNA, 305 bp, Zea mays
  unsure (1)..(305): unsure at all n locations
gccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgtggtgtcctgcaacatttctccacnaggaccagccgcgcgcatgcgcggaanggcgc

SEQ ID NO: 1495 - DNA, 284 bp, Zea mays
cccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtccgt

SEQ ID NO: 1496 - DNA, 263 bp, Zea mays
ggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtggtctgcggataccgtgatgtcggcaaagggttgtgctgctgccctcaagcag

SEQ ID NO: 1497 - DNA, 347 bp, Zea mays
  unsure (1)..(347): unsure at all n locations
ctccctcactcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaagtccgtggtgtctgcaacatcttctccacgangaccacg

SEQ ID NO: 1498 - DNA, 275 bp, Zea mays
  unsure (1)..(275): unsure at all n locations
ctgagggtcgcctgatgaaccttgggtgtgctactggccatcctagctttgtcatgtcctgctcattcacnnaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccat

SEQ ID NO: 1499 - DNA, 306 bp, Zea mays
  unsure (1)..(306): unsure at all n locations
ccgttccatttccccatctcccagatccaattcgcgagttctccctcctctgccgccatggcgctctctgtggagaagacctcgtctggacgggagtacaaggtcaaggatctctcgcangcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgatgtccgctgg

SEQ ID NO: 1500 - DNA, 280 bp, Zea mays
  unsure (1)..(280): unsure at all n locations
gtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagncccagactgaccgctgggtgttccccgagaccaacactggcatcattgtccttgttgagggtcgctgatgaacttnggggtgcaattggccatcccaactttggc

SEQ ID NO: 1501 - DNA, 293 bp, Zea mays
  unsure (1)..(293): unsure at all n locations
cgagnacgcgtgggttccccgagaccaacactggcatcattgtccttgctgagggtcgcctgatgaaccttgggtgtgctaatntgccatcctaagcttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgt

SEQ ID NO: 1502 - DNA, 307 bp, Zea mays
cggacctggcgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggt

SEQ ID NO: 1503 - DNA, 232 bp, Zea mays
tcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaacct

SEQ ID NO: 1504 - DNA, 277 bp, Zea mays
  unsure (1)..(277): unsure at all n locations
tcggccgcctcgagattgagctggccgaggtcgaaatgcccggcctcatggcgtgccgcgccgagttcggcccgtccaagnccttcgccggcgctaggatctcggggtctctccacatgaccatccagaccgccgtcctcatcgagaccctcaccgcgctcggcgccgaggtccgctggtgctcctgcaanatcttctccacgcaggaccacgctgccgcngccatcgcgagcaantcggccgcngtnttcgcttaaanggggaaaccctcgngnat

SEQ ID NO: 1505 - DNA, 234 bp, Zea mays
  unsure (1)..(234): unsure at all n locations
gttgtctctgaagctgacatcttcgtgaccaccactggcaacaaggatatcatcatggttgaccacatgaggaanatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgct

SEQ ID NO: 1506 - DNA, 238 bp, Zea mays
tgaaggagaggcttgtcggcgtctctgaggagaccaccacgggtgtcaagaggctctaccagatgcaggagaccggcgccctcctcttccctgccattaacgtcaacgattccgtcaccaagagcaagtttgacaacctgtatggttgccgccactcactccctgatggtctgatgagggccaccgacgttatgatcgccggtaaggttgccgtggtctgcggatacggtgatgtttg

SEQ ID NO: 1507 - DNA, 281 bp, Zea mays
gtcgcacgcacgcgtacgtaagctcggaattcggctcgagggcgacgccacgctgctcatccacgagggtgtcaaggccgaggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcg

SEQ ID NO: 1508 - DNA, 235 bp, Zea mays
  unsure (1)..(235): unsure at all n locations
gaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggnc

SEQ ID NO: 1509 - DNA, 299 bp, Zea mays
  unsure (1)..(299): unsure at all n locations
agatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgangtccgtggtgtcctgcaacatttc

SEQ ID NO: 1510 - DNA, 280 bp, Zea mays
gaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcatcactaaccaggtcatgcccaacttgaactgtggaaggagaagagctctggcaa

SEQ ID NO: 1511 - DNA, 298 bp, Zea mays
ctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgag

SEQ ID NO: 1512 - DNA, 250 bp, Zea mays
  unsure (1)..(250): unsure at all n locations
gaccacatgaggaagatgaagaacaatgccattgtctgcaacattggccactttgacaatgaaattgatatgctcggccttgagacctaccctggcgtcaagcgcatcaccatcaagcccnagactgaccgctgggtgttccccgagaccaacactggcatcattgtccttgctgagggtcgcctgatgaaccttgggtgtgctactggccatcctagcttggncatgtccnngctaannantaacnagg

SEQ ID NO: 1513 - DNA, 291 bp, Zea mays
  unsure (1)..(291): unsure at all n locations
ccgttccatttccccatctcccagatccaattcgcgagttctccctcctctgcctcgacnggggcgaggcgggcggccccgacctcatcgtcgacgacggcggcgacgccacgctgctcatccacgagggtgtcaaggccgaggaggattacgagaagaccgncangatccccgacccggagtccaccgacaacgctgagttcaagatcgtgctcaccatcatccgcgacgggctcaaggctgaccccaagaagtaccgcaagatgaaggagaggcttgtcggcgtctctg

SEQ ID NO: 1514 - DNA, 300 bp, Zea mays
tctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgagg

SEQ ID NO: 1515 - DNA, 237 bp, Zea mays
  unsure (1)..(237): unsure at all n locations
atcgaccccatctgtnccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatc

SEQ ID NO: 1516 - DNA, 245 bp, Zea mays
tcaagccccagactggccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttg

SEQ ID NO: 1517 - DNA, 298 bp, Zea mays
ctctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccg

SEQ ID NO: 1518 - DNA, 239 bp, Zea mays
ggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgattccgtcacca

SEQ ID NO: 1519 - DNA, 278 bp, Zea mays
  unsure (1)..(278): unsure at all n locations
cctgatgaaccttgggtgtgctactggccatcctancctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactag

SEQ ID NO: 1520 - DNA, 272 bp, Zea mays
agctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtcttgctgagggtcgctgatgaacttggtgtgtatggccatctagtttgtcatgtct

SEQ ID NO: 1521 - DNA, 283 bp, Zea mays
  unsure (1)..(283): unsure at all n locations
cccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgacgagttcggcccgtccaagcccttcgccggcgctaggatctcggggtctctccacatgaccatccagaccgccgtcctcatcgagaccctcaccgcgctcggcgncg

SEQ ID NO: 1522 - DNA, 235 bp, Zea mays
gacctaccctggcgtcaagcgcatcaccatcaagccccagactgaccgctgggtgttccccgagaccaacactggcatcattgtccttgctgagggtcgcctgatgaaccttgggtgtgctactggccatcctagctttgtcatgtcctgctcattcactaaccaggtcattgcccaacttgaactgtggaaggagaagagctctggcaagtatgagaagaaggtgtatgtgctc

SEQ ID NO: 1523 - DNA, 313 bp, Zea mays
  unsure (1)..(313): unsure at all n locations
ccgagcgctgcctcgactggggcgaagcgggcggccccgacctcatcgtcgacgacggcggcgacgccacgctgctcatccacganggtgtcaaggccgaggaggattacgagaagaccggcaaaatncccgancccggagatcancgganaaagcgngtncaaaaagtggnncaanaataatcgggaaggggtnaangntnaccccnagaagtaccgcaagatgaangagaggcttgtnggcgtctctnaggagaccaccacgggtgtnaagaggctctaccagatgcaggagaccggcggcctctctttcc

SEQ ID NO: 1524 - DNA, 299 bp, Zea mays
  unsure (1)..(299): unsure at all n locations
ctcgttccatttccccatctcccagatccaattcgcgagtnctccctcctctgcggccatggcgctctctgtggagnagacctcgtnnngacgggagtacaaggtcaaggatctctcgcaggcggacttcggccgcgccgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcancgcgctcggcgccgagg

SEQ ID NO: 1525 - DNA, 232 bp, Zea mays
ggaggattacgagaagaccggcaagatccccgacccggagtccaccgacaacgctgagttcaagatcgtgctcaccatcatccgcgacgggctcaaggctgaccccaagaagtaccgcaagatgaaggagaggcttgtcggcgtctctgaggagaccaccacgggtgtcaagaggctctaccagatgcaggagaccggcgccctcctcttccctgccattaacgtcaacgat

SEQ ID NO: 1526 - DNA, 317 bp, Zea mays
  unsure (1)..(317): unsure at all n locations
cctcactcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcntttcgccggcgctaggatcttcggggtctctccacatgaccatccagaccgccgtcctcatcgagaccctcaccgcgctggcgccgaagtccgctggtgt

SEQ ID NO: 1527 - DNA, 289 bp, Zea mays
tcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgct

SEQ ID NO: 1528 - DNA, 299 bp, Zea mays
  unsure (1)..(299): unsure at all n locations
ctcactctcgttccntttccccntctcccagatccaattcgcgagtnctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgcngcgacgagttcggcccgtccaagcccttcgccggcgctaggatctcggggtctctccacatgaccatccagaccgccgtcctcatcgagaccctcaccgcgctcggng

SEQ ID NO: 1529 - DNA, 245 bp, Zea mays
ctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgaggg

SEQ ID NO: 1530 - DNA, 287 bp, Zea mays
cccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgc

SEQ ID NO: 1531 - DNA, 283 bp, Zea mays
  unsure (1)..(283): unsure at all n locations
gctcaccatcatccgcgacgggctcaaggctgaccccaagaagtaccgcaagatgaagganaggcttgttcggcgtctctgaggagaccaccacgggtgttcaagaggctctaccagatgcaggagaccggcgccctcntcttccctgccattaacgtcaacgattccgtcaccaagagcaagtttganaacctgtatggttgccgccantcgtcctgatggtctgatgagggcactgacgttatgatcgccggaaggtngccgtggtctgcgaatacgtntt

SEQ ID NO: 1532 - DNA, 301 bp, Zea mays
  unsure (1)..(301): unsure at all n locations
ccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgncgagttcggcccgtccaagcccttcgccggcgctaggatctcggggtcttccacatgaccatccagaccgccgtcctcatcgagaccctcaccgcgctcggcgcgaggtccgt

SEQ ID NO: 1533 - DNA, 268 bp, Zea mays
  unsure (1)..(268): unsure at all n locations
ctgagggtcgcctgatgaaccttgggtgtgntactggccatcctagnctttgtcatgtcctgctcattcactaaccaggtcattgcccaacntgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgaggtcctacaagcct

SEQ ID NO: 1534 - DNA, 286 bp, Zea mays
  unsure (1)..(286): unsure at all n locations
ctctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgangtcgaaatgcccggcctcatggcgtgccgcgccgagttcggcccgtccaancccttcgccggcgctaggatctcggggtctctccacatgaccatccagaccgccgtcctcatcgagaccctcaccg

SEQ ID NO: 1535 - DNA, 233 bp, Zea mays
  unsure (1)..(233): unsure at all n locations
gcaantttgacaacctgtatggttgccgccactcactccctgatggtctgatganggccaccgacgttatgatcgccggtaaggttgccgtggtctgcggatacggtgatgttggcaagggttgtgccgctgcantcaagcaggctggtgcccgtgtcattgtgaccgagatcgaccccatctnngccctccaggctctgntggagggtcttcaggtccttcccttggaggac

SEQ ID NO: 1536 - DNA, 339 bp, Zea mays
  unsure (1)..(339): unsure at all n locations
ctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaagatctcggggtctctccacatgaccatccagaccgccgtcctcatcgagaacctcaccgcnttggcgccgaagtccgtggtgtcctgcaanattttccangcagaccaggcggcggcggcatgggcggatgg

SEQ ID NO: 1537 - DNA, 263 bp, Zea mays
  unsure (1)..(263): unsure at all n locations
antggngnancggggctcaaggctgaccccaagaagtaccgcaagatgaaggagagacttgtcggcgtctctgaggagacnnccacggganttcaagaggcactacncagatgcagganaccggcgccctcctcttccctgccattaacgtcaacgattccgtcaccaagagcaagtttgacaacctgtatggttgccgccactcgctccctgatggtctgatgagggccactgacgttatgatcgccggaaaggttgccgtg

SEQ ID NO: 1538 - DNA, 226 bp, Zea mays
  unsure (1)..(226): unsure at all n locations
attgtgaccgagatcgaccccatctgtgccctccaggctctgatggagggtcttcaggtccttcccttggaggacgttgtctctgaagctgacatcttcgtgaccaccactggcaacaaggatatcatcatggttgaccacatgaggaagatgaagaacaatgccattgtctgcaacattggccactttgacaatgaaattgatatnctcggccttgatacctacc

SEQ ID NO: 1539 - DNA, 302 bp, Zea mays
  unsure (1)..(302): unsure at all n locations
ctcactcccgttccntttccccatctcccagntccanttcgcgagttctccctcctctgccgccatggcgntctctgtggagaagacntcgtctggacgggagtacaaggtcaaggatntctcgcaggcgganttcggccgcctcgagattganctggccgaggtcgaaatgcccggcctcatggcgtgccgcgccgagttcggcccgtccaancccttcgccggcnctaggatntcggggtctctccacatgaccatccagaccgccgtcctcatcgagaccctcaccgcgctcggcntga

SEQ ID NO: 1540 - DNA, 277 bp, Zea mays
  unsure (1)..(277): unsure at all n locations
agctgacatcttcgtgaccaccactggcaacaaggatatcatcatggttgaccacatgaggaagatgaagaacaatgccattgtctgcaacattggccactttgacaatgaaattgatatgctcggccttgagacctancctggcgtcaaggcatcaccatcaagccccagactgancgctgggtgtttccccgagaccaacactggcatcattgtccttgctgagggtcgctggatgnancttgggtgtgctactgggcatcctagttttgtcatg

SEQ ID NO: 1541 - DNA, 274 bp, Zea mays
ccgttccatttccccatctcccagatccaattcgcgagttctccctcctctgcctcgactggggcgaggcgggcggccccgacctcatcgtcgacgacggcggcgacgccaacgctgctcatccacgagggtgtcaaggccgaggaggattacgagaagaccggcaagattccgacccggagtccaccgacaacgctgagttcaagatcgtgctcaccatcatccgcgacgggctcaaggctgaccccaagaagtaccgcaagatgaaggagag

SEQ ID NO: 1542 - DNA, 243 bp, Zea mays
  unsure (1)..(243): unsure at all n locations
cggaacgctgggangctgacatcttcgtgaccaccactggcaacaaggatatcatcatggttgaccacatgaggaagatgaagaacaatgccattgtctgcaacattggccactttgacaatgaaattgatatgctcggccttgagacctaccctggcgtcaagcgcatcaccatcaagccccagactgaccgtgggtgttccccgagaccaacactggcatcatgtcttgtgaaggtcgctg

SEQ ID NO: 1543 - DNA, 284 bp, Zea mays
cctcactcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagacc

SEQ ID NO: 1544 - DNA, 261 bp, Zea mays
  unsure (1)..(261): unsure at all n locations
ctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgancatccagaccgccgtcctcatcgagaccct

SEQ ID NO: 1545 - DNA, 280 bp, Zea mays
ctctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccc

SEQ ID NO: 1546 - DNA, 288 bp, Zea mays
ctccctcactcccgttccatttccccatctcccagatccaattcgcgagttctccctcctctgccgccatgcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccct

SEQ ID NO: 1547 - DNA, 260 bp, Zea mays
  unsure (1)..(260): unsure at all n locations
atctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgcngtcctcatcgagac

SEQ ID NO: 1548 - DNA, 212 bp, Zea mays
  unsure (1)..(212): unsure at all n locations
tactggtggtgcaccgagcgctgcctcgactggggcgaggcgggcggccacgacctcatcgncgacgacggcggcgacgccacgctgctcatccacgagggtgtcaaggccgaggaggattacgagaagaccggcaagatccccgacccggagtcanccgacaacgctgagttcaagatcgtgctcaccatcatccgcgacgggctcaaggt

SEQ ID NO: 1549 - DNA, 277 bp, Zea mays
  unsure (1)..(277): unsure at all n locations
cggacgntggtagtggttgtgccgctgcactncaagcaggctggtgcccgtgtcattgngnccgagatcgaccccatctgcnccctccaggctctgatggagggtcttcaggtccttcccttggaggacgttgtctcggaagctgacatcttcgtgaccaccactggcaacaaggatatcatcatggttgaccacatgaggaagatgaagaacaatgccattgtctgcaacattggccatttgacaatgaattgatatgctcggccttgagacctac

SEQ ID NO: 1550 - DNA, 277 bp, Zea mays
  unsure (1)..(277): unsure at all n locations
ggtgcaccgagcgctgcctcgactggggcgangcgngcggcnccgacctcatcgtcgacgacggcngcgacgccacgctgctcanccacganggtgtcaaggccgntggggattacgagnagaccggcnagatccccgacccggngtncaccgacaacgctgagttcaagatcgtgctcaccatcntccgngacgggctnaacgctgaccccaagaagtaccgcnaantgaangagangttgtaggcgtctctgangagancacnacgggtgtnaag

SEQ ID NO: 1551 - DNA, 291 bp, Zea mays
  unsure (1)..(291): unsure at all n locations
ctttgtcatgtcctgctcattcactaaccaggtcattgccnaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgcta

SEQ ID NO: 1552 - DNA, 274 bp, Zea mays
ctcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcg

SEQ ID NO: 1553 - DNA, 318 bp, Zea mays
  unsure (1)..(318): unsure at all n locations
tagctttgtcatgtcctgctcattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctaacaagcctgcccactaccggtactaggcagccagcacacggcttgcagctcactcgggcgttgtgtgcaannanttcganacngggcctgnaatnattt

SEQ ID NO: 1554 - DNA, 222 bp, Zea mays
  unsure (1)..(222): unsure at all n locations
gcctgatgaaccttgggtgtgctactggccatcctagctttgtcatgtcctgctcattcactaaccaggtcattgcccaacttgaactgtggaaggagaagagctctggcaagtatgagaagaaggtgtatgtgctccccaagcancttgatgagaaggttgctgctctccacttgggcaagcttggtgccaagctgaccaagttcaccaagtctcaggccg

SEQ ID NO: 1555 - DNA, 259 bp, Zea mays
catttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcc

SEQ ID NO: 1556 - DNA, 260 bp, Zea mays
cgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgcc

SEQ ID NO: 1557 - DNA, 271 bp, Zea mays
cctcactcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgcccc

SEQ ID NO: 1558 - DNA, 223 bp, Zea mays
ttcctcatgtggtcaaccatgatgaagatgaagaacaatgccattgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctgatgaacttgggtgtgctactggcca

SEQ ID NO: 1559 - DNA, 293 bp, Zea mays
  unsure (1)..(293): unsure at all n locations
cccgttccatttccccatctcccagatccaattcgcgagttctccctcctctgccgccatggcgctgctctgtggagaagacctcgtctggacgggagtacaangtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccanaccgcngtcctcatcgagacctcaccgcnttggnnc

SEQ ID NO: 1560 - DNA, 244 bp, Zea mays
cccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagaccgccgt

SEQ ID NO: 1561 - DNA, 358 bp, Zea mays
  unsure (1)..(358): unsure at all n locations
gaagngcaagtntgacnacctgtatggttgccgncactcgctcccngatggnctgatganggcnactgacgttatgatcgncggaaaagctgccgtngtcttgcgaatangtnntgtgggcaaggtggtgttnttgccctcaagaaggcngtgcccgtgtcanttgaccgagatcgaccccatctgtgcctccaggctctgatggagggtcttcaggtcttcccttggaggacgttgtctctgangtgacatcttcgtgaccaccactggcaaccaaggatatcncatggttgancacatgagaagatgaagaacaatgccattgtctgcaacattggcacttgacaagaantgtatc

SEQ ID NO: 1562 - DNA, 218 bp, Zea mays
gtcatgtcctgctcattcactaaccaggtcattgcctaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcc

SEQ ID NO: 1563 - DNA, 269 bp, Zea mays
cctccctcactctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagac

SEQ ID NO: 1564 - DNA, 260 bp, Zea mays
ctctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatccagac

SEQ ID NO: 1565 - DNA, 273 bp, Zea mays
  unsure (1)..(273): unsure at all n locations
cgactggggcgaggcgggcggccccgacctcatcgtcgacgacggacggcgacgccacgctgctncattccacgagggtgtcaaggccgaggaggactacgagaagaccggcaagatccccgatccggagtccaccgacaacgctgagttcaagatcgtgctcaccatcatccgcgacgggctcaaggctgaccccaagaagtaccgcaagatgaaggagaggttgtcggcntctctgaggagaccaccacgggtgtcaagaggctctacnat

SEQ ID NO: 1566 - DNA, 282 bp, Zea mays
cattcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcagccagcacacggcttgcagctcactcgggccgttgtgtgctatgaagttcgctac

SEQ ID NO: 1567 - DNA, 235 bp, Zea mays
  unsure (1)..(235): unsure at all n locations
ctcgcaggcggacntcggccgcctcgagattgagcnggccgaggtcgaaatgcccggcctcatggcgtggccgcgccgagttcggcccgancaaagcncttcgccggcgctaggatcncggggtctcnccacatgaccatccagaccgccgtcntcatcgagaccntcacngcgctcggcgccgaggtccgtggtgcnccngcaacatcttctccagcaggancacgccgccgcc

SEQ ID NO: 1568 - DNA, 239 bp, Zea mays
  unsure (1)..(239): unsure at all n locations
cttcggccgcctcgagattgagctggccgaggtcgaaatgcccggcctcatggcgtgccgcgccgagttcggcccgtccaagcccttcgccggcgctaggatctcggggtctctccacatgaccatccagaccgccgtcctcatcgagaccctcaccgcgctcggcgccgaggtcngctggtgctccgcaacatctttcaacgcaggacaaggcngcggcggcatcggcggattcggtg

SEQ ID NO: 1569 - DNA, 250 bp, Zea mays
gttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatc

SEQ ID NO: 1570 - DNA, 264 bp, Zea mays
ctccctcactcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatgaccatcc

SEQ ID NO: 1571 - DNA, 274 bp, Zea mays
  unsure (1)..(274): unsure at all n locations
tttcactaaccaggtcattgcccaacttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatcagcgtgccgatcgagggtccctacaagcctgcccactaccggtactaggcnacggcttgcagcttcactcgggccgttgtgtgctatgaagttcgctac

SEQ ID NO: 1572 - DNA, 289 bp, Zea mays
  unsure (1)..(289): unsure at all n locations
tttccccatctcccagatccaattcgcgagttctccctcctctgccgccatggcgctctctgtggagaagacctcgtctggacgggagtacataggtcaaggatctctcgcaangcgggacttcggccgcctcgagattgagctggccgaggtcgaaatgcccggnctcatggcgtgccgcgccgagttcggcccgtccaancccttcgccggcgctaagatctcgggggctctccacatgaccatccagancgncgtcctcatcgagaccctcancgngctngggggg

SEQ ID NO: 1573 - DNA, 276 bp, Zea mays
  unsure (1)..(276): unsure at all n locations
atcaagccccagactgaccgctgggtgttgatggtgatgcgcttgacgccagggtaggtctcaaggccgagcatatcaatttcattgtcaaagtggccaatgttgcagacaatggcattgttcttcatcttcctcatgtggtcaaccatgatgatatccttgttgccagtggtggtcacgaagatgtcagcttccgaggtcaacggctccaagctgtcgcctgangagctcgtggtgctgcaggggtgcccgtgcccgccgtctaagctccgcccg

SEQ ID NO: 1574 - DNA, 310 bp, Zea mays
  unsure (1)..(310): unsure at all n locations
ctcntcactctcgttccatttccccatctcccagatccaattcgcgagttctccctcctctgcggccatggcgctctctgtggagaagacctcgtctggacgggagtacaangtcaaggatctctcgcaggcggacttcggccgcctcgagattgagctggccgaggtcgaaatgcccggcctcatggcgtgccgcgccgagttcggcccgtccaagcncttcgccggcgtaggattcggggtctctccacatgaccatccagaccgccgtctcatcgagacctcacgcgtcggcgccgaggtcgtggtg

SEQ ID NO: 1575 - DNA, 241 bp, Zea mays
  unsure (1)..(241): unsure at all n locations
cccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctangatctcggggtctctccacatgacatcca

SEQ ID NO: 1576 - DNA, 299 bp, Zea mays
  unsure (1)..(299): unsure at all n locations
ctttgtcatgtcctgctcattcactaaccaggtcattgcccaccttgaactgtggaaggagaagagctctggcaagtatgagaagaaggtgtatgtgctccccaagcaccttgatgagaaggttgctgctctccacttgggcaagcttggtgccaagctgaccaagctcaccaagtctcaggccgactacatnccgcgtgccgatcgagggtccctacaagcctgcccacttaccggtataggcacacggcttgcagctcactcgggccgttgtgtgctatgaattcgctacatggctg

SEQ ID NO: 1577 - DNA, 272 bp, Zea mays
  unsure (1)..(272): unsure at all n locations
ccgacgctggncggnacgcgtccggttccatttccccatctcccagatccaattcgcgaagnctccctcctctgcggccanggcgctctctgtggagaagacctcgtctggacgggagtacaaggtcaaggatctctcgcaggcggacttcggccgcctcgagattgagctggccnaggtcgaaatgcccggcctcatggcgtgccgcgccgagttcggcccgtccaagcccttcgccggcgctaggatctcggggtctctccacatgacca

SEQ ID NO: 1578 - DNA, 179 bp, Zea mays
ggagaccggcgccctcctcttccctgccattaacgtcaacgattccgtcaccaagagcaagtttgacaacctgtatggttgccgccactcactccctgatggtctgatgagggccaccgacgttatgatcgccggtaaggttgccgtggtctgcggatacggtgatgttggcaagggtt

SEQ ID NO: 1579 - DNA, 278 bp, Zea mays
  unsure (1)..(278): unsure at all n locations
tccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaancccttngccggcgtaggatctcggggtcctccacatgaccatccagaccgcngtcntatcgagacctnacngngttggngg

SEQ ID NO: 1580 - DNA, 243 bp, Zea mays
cccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcctttcgccggcgtaggatctcggggtctctccacatgaccatccaga

SEQ ID NO: 1581 - DNA, 247 bp, Zea mays
ctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatg

SEQ ID NO: 1582 - DNA, 246 bp, Zea mays
ccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggtctctccacatg

SEQ ID NO: 1583 - DNA, 276 bp, Zea mays
  unsure (1)..(276): unsure at all n locations
cctccctcactctcgttccatttccccatctcccagatccaattcgcgagttctccctcctctgcggccatggcgctctctgtggagaagacctcgtctggacgggagtacaaggtcaaggatctctcgcaggcggacttcggccgcctcgagantgagccggccgagggcgaaaancccggcctcaaggcgtgccgcgccgagtnggcccgnccaagcccttcgccggcgctaggatctcggggtctctccacatgaccatccagaccgccgtcc

SEQ ID NO: 1584 - DNA, 178 bp, Zea mays
  unsure (1)..(178): unsure at all n locations
attgtctgcaacattggccactttgacaatgaaattgatatgctcggccttgagacctaccctggcgtcaagcgcatcaccatcaagccccagactgaccgctgggtgttccccgagaccaacactggcatcattgtccttgctgagggtcgcctganganccttgtgtgtactnntg

SEQ ID NO: 1585 - DNA, 175 bp, Zea mays
  unsure (1)..(175): unsure at all n locations
cgacggcggcgacgccacgctgctcatccacgagggtgtcaaggccgagaaggagtacgagangaccggcaagatccccgacccggagtccaccgacaacgctgagttcaagatcgtgctcaccatcatccgcgacgggctcaaggctgaccccaagaagtaccgcaagatgaag

SEQ ID NO: 1586 - DNA, 235 bp, Zea mays
  unsure (1)..(235): unsure at all n locations
tccccatctcccagatccaattcgcgagttctccntcctctgccgccatggcgctctctgtggagaagacctcgtctggacgggagtacaaggtcaaggatctctcgcaggcggacttcggccgcctcgagantgagctggccgaggtcgaaatgcccggcctcatggcgtgccgcgccgagttcggcccgtccaagcccttcgccggcgctaggatctcggggtctctccacat

SEQ ID NO: 1587 - DNA, 180 bp, Zea mays
  unsure (1)..(180): unsure at all n locations
ancaagtttgacaacctgtatggttgccgcnactcgctccctgatggtctgatgagggccactgacgttatgatcgccggaaaggttgccgtggtctgcggatacggtgatgtcgnnangggttgtgcngctgcnctcaagcaggctggtgcccgtgtnatcgtgancgngatcgacccc

SEQ ID NO: 1588 - DNA, 236 bp, Zea mays
cccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatctcggggt

SEQ ID NO: 1589 - DNA, 272 bp, Zea mays
  unsure (1)..(272): unsure at all n locations
ccttgggaggacgttgtctcggaagctgacatcttcgtgaccaccactggcaacaaggatatcatcatggttgaccacatgaggaagatgaagaacaatgccattgtctgcaacattggccacattgacaaagaaatgntangcncgggcccgnagaccnaacccggcggcaanngnancaacaacnaggcccagacggancgccggggggnccccgagaccaacacggnaacaagtcctgncgaggggcgcccgangaaccatnggggagc

SEQ ID NO: 1590 - DNA, 260 bp, Zea mays
  unsure (1)..(260): unsure at all n locations
ccctcactcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagccnttcgccggcgctaggatctcgggggtctctccacatganca

SEQ ID NO: 1591 - DNA, 245 bp, Zea mays
  unsure (1)..(245): unsure at all n locations
cctcactcccgttccntttccccntctcccagntccanttcgcgagttctccctcctctgccgccatggcgctctctgtggagaagacctcgtctggacgggagtacaaggtcaaggntctctcgcaggcggacttcggccgcctcgagattgagctggccgaggtcgaaatgcccggcctcatggcgtgccgcgccgagttcggcccgtccaagcccttcgccggcgctaggatctcggggtct

SEQ ID NO: 1592 - DNA, 209 bp, Zea mays
  unsure (1)..(209): unsure at all n locations
cccagatccaattcgcgagtnctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgctaggatt

SEQ ID NO: 1593 - DNA, 221 bp, Zea mays
  unsure (1)..(221): unsure at all n locations
cccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtcnaagcccttcgcnggcggtaaggntttggg

SEQ ID NO: 1594 - DNA, 226 bp, Zea mays
ctctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagcccttcgccggcgcta

SEQ ID NO: 1595 - DNA, 149 bp, Zea mays
ccctcgaggagtactggtggtgcaccgagcgctgcctcgactggggcgaggcgggcggccccgacctcatcgtcgacgacggcggcgacgccacgctgctcatccacgagggtgtcaaggccgaggaggattacgagaagaccggcaag

SEQ ID NO: 1596 - DNA, 301 bp, Zea mays
  unsure (1)..(301): unsure at all n locations
cccgtnccatntcncccatnncccagatccaatttcgcgagtacnaccncctcnagncgccatgggggctctctgtggagaagacatcgtctggacgggagtacaaggtcaaggatcnctcgcaggcggacntcggccgcntcgagattgagcnggccgaggtcgaaatnacccggnctcatggcgtncngcgccgagttcggcccgtccaagcncttcgccggcgctangattcggggtctctaccacatgaccatccagacggcgtcctcatcgagacatcacagcgtcggngccgagt

SEQ ID NO: 1597 - DNA, 174 bp, Zea mays
  unsure (1)..(174): unsure at all n locations
ccacgctgctcatccacgagggtgtcaaggccgaggaggagtacgagaagaccggnaagatccccgacccngngtccaccgataacnctgnnttcaagatcgtggctcaccatcatccgcgacgggctcaaggctgacnccaagaagtaccgcaagatgaaggagnggctngtt

SEQ ID NO: 1598 - DNA, 228 bp, Zea mays
  unsure (1)..(228): unsure at all n locations
ccctcactcccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggnctcatggcgtgccgcgccgagttcggcccgtccaagcccttcgccggg

SEQ ID NO: 1599 - DNA, 227 bp, Zea mays
  unsure (1)..(227): unsure at all n locations
cccagatccaattcgcgagttctccctcctctgcggccatggcgctctctgtggagaagacctcgtctggacgggggtacaaggtcaaggatctctcgcaggcggacttcggccgcctcgagattgagctggccgaggtcgaaatgcccggcctcatggcgtgccgcgccgagttcggcccgtccaagcccttcgccggcgtaggatctcggggtcctcanatgaca

SEQ ID NO: 1600 - DNA, 236 bp, Zea mays
ccgttccatttccccatctcccagatccaattcgcgagttctccctcctctgccgccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaagccttcgccggcgctaggatctcggggttc

SEQ ID NO: 1601 - DNA, 209 bp, Zea mays
ctctcgttccatttccccatctcccagatccaattcgcgagttctccctcctctgcggccatggcgctctctgtggagaagacctcgtctggacgggagtacaaggtcaaggatctctcgcaggcggacttcggccgcctcgagattgagctggccgaggtcgaaatgcccggcctcatggcgtgccgcgccgagttcggcccgtccaa

SEQ ID NO: 1602 - DNA, 426 bp, Zea mays
  unsure (1)..(426): unsure at all n locations
cctcactcccgttccatttccccanctcccagatccaattcgcgagttctcccncctctgccgccanggngctctctgtggagaagacctcntctggacgggagtacaaggtcaaggatnnctcgcaggnggacttcggtcgccncgagattganctggcngaggncgaaatgcccggccncatggcntgccgngccganttcggcccgtctangcccttcgncggcgctaggntnacngngtctcaccacatgaccatcnaagactgtnttcctcancgagaactnanggtacgacggtaccnaagtncccngatatccgngnncnacttcccaacanttgaggaacctacantgcatttcnanngaccgnaccanaattgncanatcaaaggtaaattaanncntagnctncaangggnaantg

SEQ ID NO: 1603 - DNA, 232 bp, Zea mays
  unsure (1)..(232): unsure at all n locations
ccccatctcccagatccaattcgcganttctccctcctctgcggccatggcgctctctgtggagaagacctcgtctggacgggagtacaaggtcaangatctctcgcaggcggacttcggccgcntcnatattgagctggccgaggtcgaaatgcncggcctcatagcgtgccgcgccgatttcggnccgtcnaagcccttcgccgggngctaggatctcggggtctctcca

SEQ ID NO: 1604 - DNA, 218 bp, Zea mays
  unsure (1)..(218): unsure at all n locations
ctccctcacncccgttccanttccccancncccaganccaattcgcgagttctccctcctctgccgccatggcgctctctgtggagaagacctcgtctggacgggagtacaaggtcaaggatcnctcgcaggcggacntcggccgcctcgagantgagcnggccgaggtcgaaatgcccggcctcatggcgtgccgcgccgagttcggcccgtccaag

SEQ ID NO: 1605 - DNA, 134 bp, Zea mays
gccgccactcactccctgatggtctgatgagggccaccgacgttatgatcgccggtaaggttgccgtggtctgcggatacggtgatgttggcaagggttgtgccgctgcactcaagcaggctggtgcccgtgtc

SEQ ID NO: 1606 - DNA, 152 bp, Zea mays
  unsure (1)..(152): unsure at all n locations
cgccgtcctcatcgagaccctcaccgcgctcggcgccgaggtccgctggtgctcctgcaacatcttctccacgcaggaccacgccgccgccgcnatcgcgcgcgantcggccgccgtgttcgcctgnaaagggggagacccttgaggagtag

SEQ ID NO: 1607 - DNA, 287 bp, Zea mays
  unsure (1)..(287): unsure at all n locations
gtccaagtatgagaagaaggtgtatgtgctccccaagcaccttgatgagaaggntgctgcnnctcccacttgggcaagcttggtgccaagctgaccaagctcaccaagtctcaggccgactacatcagcgtgccgatcgagggtccctacaagcctgcccactaccggtactaggcagccagcacacggcttgcagctcacttcgggccgttgtgtgctatnaagtncncncncactgncctgtcagttcatcttttgcatgcatatgcantatcatatacgcatcg

SEQ ID NO: 1608 - DNA, 123 bp, Zea mays
  unsure (1)..(123): unsure at all n locations
tgtctctgaagctgacatcttcgtgaccaccactggcaacaaggatatcatcatggttgaccacatgaggaagatgaagaacaatgccattgtctgcaacattggccactttgacaatgaant

SEQ ID NO: 1609 - DNA, 348 bp, Zea mays
  unsure (1)..(348): unsure at all n locations
atcgccggaaaggttgccgnggtctgcggatacggtgatgtnnncaagggttgtgctgctgccctcaagcaggctggtgcccgtgtcattgtgaccgagatcgaccccatctgtgcnctccaggctctgatggagggcttcaggtcttcccttggaggacgtgtctctgaagcnnacatctcgtgacaacattggcancaagtatcatcatggtgaccacatgaggaagagaagacccatgccatgtctgcacattggcactttgacatgaattgatatctcggcttgagactacctgngtcaangctcacatcagcccngatgacgtggtgtcccgagacanatgga

SEQ ID NO: 1610 - DNA, 266 bp, Zea mays
  unsure (1)..(266): unsure at all n locations
atcaagccccagactgaccgctgggtgttgatggtgatgcgcttgacgccagggnaggtctcaaggccgagcatatcaatttccattgtcaaagtggccaatgttgcagacaatggccagtggtcttcatccttcctcatgtggtcaaccatgatgaatatccttgttgccagtgggtggtcacgaagatgtcagctttccggaggnaaacggctccannctgtcgctgagaanncgtgttgcngnaggggtgcccgtgccgcngc

SEQ ID NO: 1611 - DNA, 143 bp, Zea mays
  unsure (1)..(143): unsure at all n locations
gcggatacggtgatgtcggcaagggttgtgctgctgcactcaaacaggctggtgcccgtgtcattgtgaccgagatcnaccccatctgtnccctccaggctctgatggagggtcttcaggtcnttcccttggagnacgttntt

SEQ ID NO: 1612 - DNA, 118 bp, Zea mays
aacgattccgtcaccaagagcaagtttgacaacctgtatggttgccgccactcactccctgatggtctgatgagggccaccgacgttatgatcgccggtaaggttgccgtggtctgcg

SEQ ID NO: 1613 - DNA, 265 bp, Zea mays
  unsure (1)..(265): unsure at all n locations
ttctccctcactcccgttccatttccccatctcccaganccaattcgcgagtnctccctcctctgccgccatggcgctctctgtggagaagacctcgtctggacgggagtacaaggtcaaggattctcgcaggcggacttcggccgcctcgagattgagtggccgaggtcgaaatgccggctcatggcgtgccgcggcgagttcggcccgtccaagccttcggcggcgtaagatctcggggtctttcacatgaacatcagaccgc

SEQ ID NO: 1614 - DNA, 111 bp, Zea mays
catggttgaccacatgaggaagatgaagaacaatgccattgtctgcaacattggccactttgacaatgaaattgatatgctcggccttgagacctaccctggcgtcaagcg

SEQ ID NO: 1615 - DNA, 154 bp, Zea mays
  unsure (1)..(154): unsure at all n locations
cncccagatccaattcgcgagtncncccncctctgccgccatggcgctctctgtggagaagacntcgtctggacgggagtacaaggtcaaggatctctcgcaggcggacntcggccgcctcgagattgagcnggccgaggtcgaaatncccggc

SEQ ID NO: 1616 - DNA, 226 bp, Zea mays
  unsure (1)..(226): unsure at all n locations
cccagatccaattcgcgagttctccctcctctgccgccatggcgctctctgtggagaagacctcgtcctggaacgggagnacaaggtcaaggntntntngnaggngnanttnggcngcntcnanattnanctggccnaggtcgaaatgcccggcntnatggcgtgcngcgccganttcggcccgtccaagccttcgccggcgcnaggntctcggggtcttcnacat

SEQ ID NO: 1617 - DNA, 229 bp, Zea mays
  unsure (1)..(229): unsure at all n locations
ggatatcatcatggttgccagtggtggtcacgaagatgtcagcttcagagacaacgtcctccaagggaaggacctgaagaccctccatcagagcctggagggcacagatggggtcganctcggtcacaaggntatcatcnngggtgaccacatgaggnagatgaagaacaatgccattgtctgcaacattggccactttgacaatgaaattgatatgctcggccttgag

SEQ ID NO: 1618 - DNA, 120 bp, Zea mays
  unsure (1)..(120): unsure at all n locations
ctttgtcntgtcctgctcattcactaaccaggtcattgcccaacttgaactgtgganggagaagagctctggcnagtatganaagaaggtgtatgtgctccccaagcaccttgatgagaa

SEQ ID NO: 1619 - DNA, 109 bp, Zea mays
gtgccctccaggctctgatggagggtcttcaggtccttcccttggaggacgttgtctctgaagctgacatcttcgtgaccaccactggcaacaaggatatcatcatggt

SEQ ID NO: 1620 - DNA, 96 bp, Zea mays
ggttgaccacatgaggaagatgaagaacaatgccattgtctgcaacattggccactttgacaatgaaattgatatgctcggccttgagacctaccc

SEQ ID NO: 1621 - DNA, 118 bp, Zea mays
  unsure (1)..(118): unsure at all n locations
cgctgagttcaagatcgtgctcaccatcatccgcgacgggctcnaggctgaccccaagaagtnccgcaagatgaaggagangcttgtcggcgtctctaaggagancanccangggtgt

SEQ ID NO: 1622 - DNA, 559 bp, Zea mays
  unsure (1)..(559): unsure at all n locations
gnnnnnngnntnncnagannnnttcnctttccaacncctcttgaatttccgggtcgacccacgcgtccgcaacctgtatggntgccgncactngatccctgatggtctgatgagggccactgaccgttatgntcgccggaaaggttgccgtggtctncggatacngtgatntcngcaagggttgtgctgctgcaaatnaagcanggctngtgcccgtntcattgtnacccgagancnacnnatctgtncnnntacangctcttattngaaggtctttangnccttcncttggaaganngtggctntgaagctncatnttnngaccaccactgnnaacaaggatatnnnatggttgaccacatgangaanatgaagnacaatgccattggctgnaacattgggccacttttgacaatgaanttgatatgctcnggccttgagacctaccctggcgtcaaagcgcattatncatcaaancccanactgaccgcttgggtgtttccngagaccaaacactggcatcattggtccttnctgaagggtcnnctggntnaacntt

SEQ ID NO: 1623 - DNA, 88 bp, Zea mays
cgacaacgctgagttcaagatcgtgctcaccatcatccgcgacgggctcaaggctgaccccaagaagtaccgcaagatgaaggagagg

SEQ ID NO: 1624 - DNA, 82 bp, Zea mays
atcttctccacgcaggaccacgccgccgccgccatcgcgcgcgactcggccgccgtgttcgcctggaagggggagaccctcg

SEQ ID NO: 1625 - DNA, 139 bp, Zea mays
  unsure (1)..(139): unsure at all n locations
cctcactcccgttccatttccccatctcccagatccaattcgcgagttctccctcctctgccgccatggcgctctctgtggagaagacctcgtctggacgggagtacaaggtcaaggatctctcgcangcggacttcgg

SEQ ID NO: 1626 - DNA, 255 bp, Zea mays
  unsure (1)..(255): unsure at all n locations
agcttggtgccaagctgaccaagctcaccaagtctcaggccgactacatcagcgtgccgatcgagggtccctacaagcctgcccactaccggtactaggcacacggcttgcagctcactcgggccgttgtgtgctatgaagttcgctacactggcctgtcagttatcttttgcatgcatatgcattatcatatacgcagtcgcgtanaggttttcttatggttatcgcttgancngnngngggagggaaggagct

SEQ ID NO: 1627 - DNA, 224 bp, Zea mays
  unsure (1)..(224): unsure at all n locations
acacngtccgngacgctgggnactgtncngagaacgcgtnggcggacgcgtgggtttccccatatcccagatccanttcgcgagannctccctcctangcggccatgacgctctctgtggagaagacctcgtctggacgggagtacaaggtcaaggattctcgcaggcggacttcggccgcctcgagattgagtgccnagtgaatncccggcnnntgggggngc

SEQ ID NO: 1628 - DNA, 113 bp, Zea mays
cccgttccatttccccatctcccagatccaattcgcgagttctccctcctctgccgccatggcgctctctgtggagaagacctcgtctggacgggagtacaaggtcaaggatc

SEQ ID NO: 1629 - DNA, 182 bp, Zea mays
  unsure (1)..(182): unsure at all n locations
tcctcgttccatttccccatgctccnagatccaattccgcgagtncctccctcctactgcggccatggcgctactctgtggagaagacctcgtctggaccgggagtaccaaggtcaaggatctctacgcaggcggacttcggccgntcgagattgagctggccgaggtcgaaatgcccggcc

SEQ ID NO: 1630 - DNA, 107 bp, Zea mays
  unsure (1)..(107): unsure at all n locations
ttccatttccccatctcccagatccaattcgcgagttctccctcctctgcngccatggcgctctctgtggagaagacctcgtctggacgggagtacaaagttaaagg

SEQ ID NO: 1631 - DNA, 283 bp, Zea mays
aaaatggcttctcaggtccctcacgttccgcctcgtgctgctactgtcctctcggcgacagagctcatcggaaatactcctctcgttagacttaacaagatcccccagtcgctgggcatcgagtgcgatgtctacgtcaagccagagctgttcagcgctggaggcagtgttaaggacagaattgctctgcgcatgattgaagaggcagagaagagcggaagaatcaagcctggcgacactcttatcgagcctaccagtggaaacactggtatcggtcttgctc

SEQ ID NO: 1632 - DNA, 269 bp, Zea mays
  unsure (1)..(269): unsure at all n locations
gngacgaggtgagggcggggaggatgagctgctgctgccgcgtcgcgaggatggcgacgccgcggagggcgagagtggagtggtgatgcgggtngccgtcgacgcgaancgccagngtgggtgtaggcgctcggatgcttttctacccgacgctggtgtacaacgtcgtgaggaatcggttcgagaagcacttccactggtgggatcagatcgatgagcatgtcctgctcggtgctgttccatccctagcgatgttctccggctaaaga

SEQ ID NO: 1633 - DNA, 125 bp, Zea mays
  unsure (1)..(125): unsure at all n locations
tnctggacngattgtcacatggatnacngatcnnatgcatggaaacaccatcaaggccccttgtggcctgaagacnccgtccatttgacnncatncnggctgaagtnccgtncctncttcgatgt

SEQ ID NO: 1634 - DNA, 123 bp, Zea mays
gtgctgttcgcaatgctggattaattgtcacatggattactgatcctatgcatggaaacaccatcaaggccccttgtggcctgaagactcgtccattcgactcaattctggctgaagtgcgcg

SEQ ID NO: 1635 - DNA, 312 bp, Glycine max
  unsure (1)..(312): unsure at all n locations
cgcgtcgtngctcggaattcggctcgagcttggtttgcctcttgtagcttgagacttgaggagaatggataccttcctgttcacttctgagtcggtgaacgagggtcatcccgacaagctgtgtgatcagatatctgatgcagtgctcgatgcctgcctggagcaagaccctgaaagcaaggttgcctgtgagacatgcaccaagaccaacttggtcatggtatttggagagatcaccacaaaagccaatatngactatgagaagattgtgcgcgatacgtgccgttctataggatttgtgtctggtgatgt

SEQ ID NO: 1636 - DNA, 293 bp, Glycine max
  unsure (1)..(293): unsure at all n locations
agatcgtgcgtgacacctgcaggaacatcggcttcgtctcaaacgatgtgggacttgatgctgacaactgcaaggtccttgtaaacattgagcagcagagccctgatttggccagggtgtgcacggcaacttaaccaaagacccgaggaaatcggtgtggagaccagggtcactgtttgctatgcacggacgagaccccagattgngccatgagtcatgtncttncaataaactcggtgtcgtctaccgagntcgcaagacggnacttcccnggttgggctatggaanaccna

SEQ ID NO: 1637 - DNA, 288 bp, Glycine max
  unsure (1)..(288): unsure at all n locations
tcgcangcacgcgtacgtaagctcggaattcggctcgagcaagacccaagtcactgttgagtactacaatgacaagggtgccatggttccaatccgcgtccacactgtgcncatctccacacagcatgatgagncctgtcacaaatgatgngattgcagctganctnaaagaacacgtgattaagcntgtgattccngngnagtaccttgnngagccgaccnntggccngtngaaccctctggcaggttngncttgnaggccgcgtggggatgctggnctcaccggcc

SEQ ID NO: 1638 - DNA, 292 bp, Glycine max
  unsure (1)..(292): unsure at all n locations
gngtacntaagctcggaattcggctcgagntaaantcggtgctcgtctcancgaggttcgcaagaacggtacctgcccttggntgaggcctgntgggaaganccaagtgantgttncctattanaatgacaatggtgccagggntcctatncgngtacacacngtgctaatntccacncaacacganganncntgtccnccantgacganattgctgntgncctcaaagagcatgtgntcaagnctgtgnngcnagataagtaccttgttgnggagnccatttncnttgnnc

SEQ ID NO: 1639 - DNA, 285 bp, Glycine max
  unsure (1)..(285): unsure at all n locations
tcgcangcacgcgtacgtaagctcgggaattcggctcgagctgctgcatatggacactttggaagagaggaccctgacttcacatgggaagtgatcaagccactcaagtgggaggaggcctaaggccattcattcctcaccgctgtgtgctgggagttttttgagctttgcccttatcatatctataatttgtttcatttattttacttaattcgtgtgtgcttctcactttctctncctcctctccattctattttgtttcttctatcctcatatgtaattttt

SEQ ID NO: 1640 - DNA, 275 bp, Glycine max
cgcatgcacgcgtacgtaagctcggaattcggctcgaggaagattgtgcgcgatacgtgccgttctataggatttgtgtctggtgatgttggccttgatgctgacaatgcaaggtattggtgtaccttgagcagcaaagtcctgacatagcacaaggagtccatggccacctcaccaagcgaccagaagacataggagctggcgatcagggtcacatgtttggctacgccacagatgaaacacctgagcttatgcctctcagccatgtccttgca

SEQ ID NO: 1641 - DNA, 317 bp, Glycine max
  unsure (1)..(317): unsure at all n locations
ttcannantngcatgcacgcgtacgtaagctcngaattcngctcganctcnagccgaatcggctcgagtgnagcttancctcaagtagcatgagatcaanccggtgataccggacaantancttgnntgngaagnccattttccagttcaacccctctggccgttttgtcattngaggtcctcaacngtgatgctcntctcaccagccgacaagatccattcnnccgntacttanggaggcnggggtgctcatngtggtagtgccttctccgggaacgatcccaacaaggtttatangagttgtgttacantgtgag

SEQ ID NO: 1642 - DNA, 278 bp, Glycine max
  unsure (1)..(278): unsure at all n locations
gtcgcangcacgcgtacgtaagctcggaattcggctcgagctctctacaatttttttttaatctttttgattcgcttctggcttttttgactctaaattgggacgaaaagtcgagccttcgaagaaacgcagaaactcataaaccatcgctgactccgcaattttcgtcggttcctcacacactctctgatttaancncggtgccaagctcaccgaggttcggaagaacgggacatgcccttggctgagacctgatggcaagacccaagtcactgttg

SEQ ID NO: 1643 - DNA, 259 bp, Glycine max
  unsure (1)..(259): unsure at all n locations
gatctcaagaggggtgggaataacaggttcttgaagactgctgcatatggacacttcggcagagaggaccctgacttcacatgggaagtggtcaagcccctcaagtggaatgaatgggagttttttagcgttgcccttataatgtctnttatccataactttccacgtcccttgctctgtgtttttctctcgtcgtcctcctcctatnttgtttctccngcctttcatttgtaattttttacatgatcaactaaaaaat

SEQ ID NO: 1644 - DNA, 191 bp, Glycine max
  unsure (1)..(191): unsure at all n locations
gcngcgtacgtaagctcggnnttcggctcgaggagnattntgacttcacgcctggaatgatntccatcaatcttgaccncatganaangagggaaacttcaggtanccagaagactgntgcttatggacattttggaagagatgatccggatttcacatgggagacagtgaagatactcaagcctngtgct

SEQ ID NO: 1645 - DNA, 317 bp, Glycine max
  unsure (1)..(317): unsure at all n locations
tcgcangcacgcgtacgtaagctcggaattcggctcgaggttggtcttgatgctgacaactgcaaagttctggtcaacattgagcaacagagccctgatattgctcaaggagttcacggtcatatgaccaagaaacctgaggaaattggtgctggtgaccaaggccacatgtttggttatgctacagacgaaacacctgagttaatgccactcactcatgtgcttgctactaaacttnntgccaggctcactgaggtgagaaagaacaaaacatgcccctggctgaggccagatggtaaaacccaagtgacattgag

SEQ ID NO: 1646 - DNA, 316 bp, Glycine max
  unsure (1)..(316): unsure at all n locations
ttcgcangcacgcgtacgtaagctcggaattcggctcgagngnactcactggaaggaagatcattatcgacacctatggtggttggggtgctcatggtggtggtgccttctccggcaaggacccaaccaaggttgataggagtggtgcatacattgttaggcaagcagccaagagcgtggtagcttcagggcttgcacgacgttgcattgtgcaggtttcttatgcaattggagttccagagccactttctgtgtttgtagacacataccaaacggggaagattccagacaaggacatattggctctaattaagga

SEQ ID NO: 1647 - DNA, 332 bp, Glycine max
  unsure (1)..(332): unsure at all n locations
ntntggntatgtcgcangcacgcntacgtaagctcgggnattcggctcgaggaccagggtatcatgttcggatatnccaccgacgagacccccgagctccttcctctgaccgtcctcctctcccacaanctgaactcggccatgaccaaggctcgcnaggattgtactctgccatggctgcgacccgacaccaagactcaggtcactgtcgagtacgcccacgatggcggtgccgtcgtccctctccgtgttgacaccgtcgtcgtctctgnccagcanancgaggacatcactatcgagaagctccgcgaggagatcaaggagaagatcat

SEQ ID NO: 1648 - DNA, 297 bp, Glycine max
  unsure (1)..(297): unsure at all n locations
gtcgcangcacncgtacgtaagctcggaattcggctcgagnggtgtgcacggccaccttaccaaaagacccgangnaatatcaggnctctgctgctcaaggtccttgtaaacattgagcagcagagccctgatattgcccagggtgtgcacggccaccttaccaaaagacccgaggaaatcggtgctggagaccagggtcacatgtttggctatgccactgtcgagaccccagaattgatgccattgagtcatgttcttgcaactaaactcggtgctcgtctcaccgaggttcgcaa

SEQ ID NO: 1649 - DNA, 348 bp, Glycine max
  unsure (1)..(348): unsure at all n locations
gtctcnnncacgcgtacgtaagctcgagaatcggctcgagctngcagccnggttactgtctgntnaagctanccatctctntctctctntcttaagnggntccttngnnacannntagaatggcctnagaaattncctattcacnctnnatcagtgaacgngnggcancctgcacaggnnctgtgaccagatctccgatgctgtgntcngattcatgcttggagcaggaccctgagagcaaggttgcctgtgaagcctgcaacaagaccaacatggtggtggttttcggagagatcacaaccaaggccaacgtggnctatganaagattgtgcgggacacatgcaagg

SEQ ID NO: 1650 - DNA, 324 bp, Glycine max
  unsure (1)..(324): unsure at all n locations
ntcgcgtgcagcgtacgtaagctcggaattcggctcgaggcgagtgttctttcttcgtttcaacaccttnntttgcanncgntgcttcttctcgcttgaganntggcacaagaaaccnttctatncacatctgantctgtanacgagggtcaccccggacaagctgtgcgnccagatctctgatggcagtgctcgatgcgtgcctgnacnggaccctgagcagcgaggttgcctgtnagacatgcaccaagaccngnntggncatggtctttggngagatcagnanccaaggncagcagtaggctatgagaannttnnncgtga

SEQ ID NO: 1651 - DNA, 318 bp, Glycine max
  unsure (1)..(318): unsure at all n locations
tcacangcacgcgtacgtaagctcggaattcggctcgaggcagacttcacctgggaagttgtgaagccactcaagtcagagaagcctcaagcttaagagtgttgttaagttaatcactacccttcagtggntgtcttgctgggtgtggatgaataatttgcgtgtttcatgactactactactactactccnttcnntgtctaatgccatctcatcnatnnctaaactgntcgntttntttttnctccntatactcncaatttgttgtttggcnatgnaatgtcactgtgttgatgcatggaattttatccaaangaa

SEQ ID NO: 1652 - DNA, 312 bp, Glycine max
  unsure (1)..(312): unsure at all n locations
ncgcntgcacgcgtacgtaagctcggaattcngctcgagnggctcgagcgcttgcctcgaacaggacccagacagcaaggttgcctgcgaaacatgcacnaaaaccaacttggtcatggncttcggagaaatcacgaccaaggccaatgttgactacgagaagatagtgcgtgtacaccctgagcaatatcagggctctgctgctcaatgttgacgaggaccttgcagttgtcggcatccagtcccacatcgtttgagacaaagccgatgttcccgaatatcttgttgtttggagcgatccgagaaaaactc

SEQ ID NO: 1653 - DNA, 320 bp, Glycine max
  unsure (1)..(320): unsure at all n locations
tcgntncantaanagtcgnangcacgcgtacgtnagctcggaattcggctcnnnctgtaanccgagggtcaccccgacaancntgtgcgacnagatctctgatgcagtgctcgatgcgtgccttgaacaggaccctgacagcaaggttgcctgtgagacatgcaccaagaccaacatggtcatggtctttggagagatcacaaccagggcaangtanannntgagaagantgtccnggananangccgcgaaattggattcnaccccggannanttgggtnnnnncnnnaaaantnnnggntnggncaannnttgnncnc

SEQ ID NO: 1654 - DNA, 506 bp, Glycine max
  unsure (1)..(506): unsure at all n locations
ggntnnnnnnaactnttacgctctcaggtgcccgtcanagaattnacgggtcgagccacgcgtcagtacggatgcgagaagacgacagaagggggcagcgcttgagaccaagccccactcaaccaacacaacactctctctgctcctcctctaactttcaaagttttttaagtnnttagatggcagagacattcctaattacctcaaagtcnctnaacgaagganacctgacaagctctgcgaacaaatntccgatgctgtnctnnaancctgccttgaacaagacccaaacagcaaagttncctgccaaacatgccccaagaccaactttgtcnangtcctccgagaaattnccaccaagggcaacnttnactacganaanatnntgcgttacacctgcnggaacatcgggttcntctcaaacgaagttggactttatgcctgacaaatgcaanggccctnttaacaatngnccancaaaaccctgaaantnnccaagggggttg

SEQ ID NO: 1655 - DNA, 501 bp, Glycine max
  unsure (1)..(501): unsure at all n locations
ggnnnnnnnnnnnanctttaactctccgcgttcaggtaaaggtttagaattcccgggncgacccacgcgtcnancccangcgtccgtacggctgcgagaggangacagaagggggcagcgcttgagaccaagccccactcaaccaccacaccactctctctgctcntcttctatctttcaacgtttttnaagtattaagatggcataaacattcctatttacttcatantcagtnaangagggacacnctgacgtnctctgcgannanatctcngattctgtcctcnacncntgccttnatnatgacncacncancatcgttgcttgntanatatacnccangaccaacttngtcntggtcttcggagagatnnccatnatggcnaacgttgactancatgaagatcntgcntnacacctgcaagaattcggattcgtctcaaaccatgttggganttatgctgannntgnaaggttcnttgnaaacggttgnccntttca

SEQ ID NO: 1656 - DNA, 533 bp, Glycine max
  unsure (1)..(533): unsure at all n locations
angggtgatattntgtgtcnaaaggtatagtangtgntagattntcttcggtttcggtattaccnacnngacccacgcgtcccgcccacgcgtccggctgcgataagacgacagaangggatacctatggtggctggggtgngggatggtggaagtgccttttgggggaangaccctaccaaggttgacagaagtggtgcctatattgtaaggcatgctgcaaanagtgtngtggcaaatggccttgctanaaggtgcattgtgcaagtttcctatnccattggtgtccctgaacccttgtcanatgtttntngacacttatngaactgnnaanattcnanacaanngagattttnctatanntatangaataatttttannttnananctngnnnngtntnncataaannttngtaantaaataagnnnnaantnttttgtnnatttaanaaattntantnttnntttanatagnnaaataatttttnaagntnatttnnngtnnntttnnaaattatgtannatatntctt

SEQ ID NO: 1657 - DNA, 314 bp, Glycine max
  unsure (1)..(314): unsure at all n locations
tacttgtttcngaatnaccggcnggacccacgcgtccgtacggctgcgagaagacgacagaagggggtggctggggtgctcatggtggagatgnggggtcaggnaaagacnnnggggggggttgacagaantggtgcctatattgtaaggcangctgcaaagantgncgtggcaaatggccttgctagaangtgcattgtncaagtttcctatgcnattngtgtncctaanccntnntaaatgttnttngatncnnattgaanttnnaantanttcattnataangataatttanataattaanaatngangaa

SEQ ID NO: 1658 - DNA, 557 bp, Glycine max
  unsure (1)..(557): unsure at all n locations
gnnnggggggngttttcggccacgttgnactaggagacttcnttggaacgcccnggangnttcgggncgacccacgcgnccggcnngccncanngaaccaccacacctcttntcgtttttgctaccccnttctgcnctacggggaccgggnaagttttaanngggtaangatggcagagacaatnnnatttaccnnagagtcggtgaacgagggacaccctgacaagcnntgcgaccaaatncccnatgctgtcctcnacgcttgcctngagcaggacccanacagcaaagngtgnctgctgaaacatgcaccaaaaccaactnggncatgggcttgggagaaatnacaaccaaggncacggcngactacgacaagatagnncagagacacctgcangaacntnggacntcgnntnaaatgaagtgngganttggatgccnnnaacttgccaagntccnnngntaaccattgtacaatnatgatccccggngagttggtcnaggcntacaagggnccacnntntcnanaaancngganttattngnnnnttggtgnc

SEQ ID NO: 1659 - DNA, 285 bp, Glycine max
  unsure (1)..(285): unsure at all n locations
cgtcgcangcacgcgtacgtaagctcggaattcggctcgagnnactttcctcttcacctcagaatctgtaaacgaaggccatcccgacaagctgtgtgaccaggtttcagatgccatcctagatgcatgcttggagcaagacccagaaagcaaggttgcttgcgagacctgtacaaaaactaacatggttatggtctttggtgagattacaaccaaggccagcgtgaactacgagaaaatagttcgagacacttgcaaaggcattgggtttgtgtcaccagatgt

SEQ ID NO: 1660 - DNA, 304 bp, Glycine max
cacgcgtacgtaagctcggaattcggctcgagcttcctcttcgcacaaagcagcaagcatccttgagatggaaactttcctcttcacctcagaatctgtaaacgaaggccatcccgacaagctgtgtgaccaggtttcagatgccatcctagatgcatgcttggagcaagacccagaaagcaaggttgcttgcgagacctgtacaaaaactaacatggttatggtctttggtgagattacaaccaaggccagcgtgaactacgagaaaatagttcgagacacttgcaaaggcattgggtttgtg

SEQ ID NO: 1661 - DNA, 283 bp, Glycine max
  unsure (1)..(283): unsure at all n locations
gtcgcangcacgcgtacgtaagctcggaattcggctcgagntccatcttcttcttctcttcctcttcgcacaaagcagcaagnatccttgagatggaaactttcctncttcacctcagaatctgtaaacgaaggccatcccgacaagctgtgtgaccaggtttcagatgccatcctagatgcatgcttggagcaagacccagaaagcaaggttgcttgcgagacctgtacaaaaactaacatggttatggtctttggtgagattacaaccaaggccagcgtga

SEQ ID NO: 1662 - DNA, 447 bp, Glycine max
  unsure (1)..(447): unsure at all n locations
gagctggtgaccagggtcacatgtttgggtatgccaccgatgaaacccccgagtacatgcccctcagccatgtccttgcaaccaaacttggtgctcgcctcacagaggttaggaagaatggcacctgtgcttggttgaggccagatggtaagacacaagtaaccgtcgagtactacaatgacaatggtgccatggttccagttcgtgtccacactgtcctaatttccacccaacatgatgagactgtgagcaatgatcaaattgctgcggaccttaaagagcatgttatcaagcctgtcattcctgagaagtaccttgatgagaagaccatcttccaccttaacccttctggccgttttgtcattggtggccctcatggtgatgctggtctcactgggaagaaagatnatcattgatacctaaggtggctggggtgctcaaggtgga

SEQ ID NO: 1663 - DNA, 475 bp, Glycine max
  unsure (1)..(475): unsure at all n locations
ccacgcgtccgcacaaagcgggttactgtctgttcaagctaccatctctctctctctttcttagngcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgagaagattgtgcgtgacacatgcaggaacattggttttgtctctgatgatgttggtcttgatgctgacaactgcaaggtcctcgtcaacattgagcaacagagtcctgatattgctcaaggtgtgcacggncacctnacaaagaggcctgaggagattggtgctggtgaccaaggtcatatgttcgg

SEQ ID NO: 1664 - DNA, 520 bp, Glycine max
  unsure (1)..(520): unsure at all n locations
gnngnnnnnnaggaggtnntgntntggaancnnnnnnnnnnnnnnnnnnnnnnnnnnnnnnnnnnnnnnnnnnnnnnnnnnnnnnnnnnnnnnnnnnnnngagaagacgacagaaggggtctcaaatgatgtgggactggatgccgacaactgcaaggtcctcgtcaacattgagcagcagagccctgatattgctcagggtgtacacggccaccttaccaaaaaacctgaagaaattggtgctggtgaccagggtcacatgtttggctatgccactgatgaaacccctgaattgatgccattgagccatgttcttgcaacaaaactcggtgctcgtctcaccgaggttcgcaagaacggtacctgcccttggctgaggcctgatgggaagacccaagtgaccgttgagtattacaatgacaatggtgccagggttcctattcgtgtacacaccgtgctaatctccacccaacacgacgagactgtcaccaatgaccaaattgntgnttaacctnaaaaa

SEQ ID NO: 1665 - DNA, 494 bp, Glycine max
  unsure (1)..(494): unsure at all n locations
ggngnnnngaatgatctaggtnntctatgccgagacatgacgnaaganccacgngtacgtaaactcggaattcggctcgagaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatnacaaccaaggccaacgtggactatgagaagattgtgcgtgacacatgcaggaacattggttttgtctctgatgatgttggtcttgatgctgacaactgcaaggtcctcgtcaacattgagcaacagagtcctgatattgctcaaggtgtgcacngg

SEQ ID NO: 1666 - DNA, 502 bp, Glycine max
  unsure (1)..(502): unsure at all n locations
gnagtgtttgntntggggggggggagnnnnnnnnnnnnnnnnnnnnnnnnnnnnnnnnnnnnnnnnnnnnnnnnnnnnnnnnnnnnnnnnnnnnnnnnnnnnnaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgagaagattgtgcgtgacacatgcaggaacattgggttttgtctctgatgatgttggtcttgatgctgacaactgcaaggtccctcgtcaacattgagcaacagagtcctgatattgctcaaggtg

SEQ ID NO: 1667 - DNA, 372 bp, Glycine max
  unsure (1)..(372): unsure at all n locations
gttaaaatggcccaagaaactttcctattcacatctgaatcagtgaacgaggggcacctgacaagctctgtgaccagatntccgatgctgtgctcgatgcatgcttggagcaggacctgacagcaaggttgcctgtgaaacctgnaccaagaccaacatggtgatggttttcggagagatcacaaccaaggccaacgtggactatgagaagattgtgcgtgacacatgcaggaacattggttttgtctctgatgatgttggtcttgatgctgacaactgcaagtcctcgtcaacattgagcaacagagtcctgatattgctcaaggtgtgcacggccactcacaaagaggcctgaggagattggtgtggtna

SEQ ID NO: 1668 - DNA, 487 bp, Glycine max
  unsure (1)..(487): unsure at all n locations
tgaatttangttgcctgcccaagagaatgaagtcgcanccacgcgtacgtaaactcggaattcggctcgaggtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacgagaagatagtgcgtgacacctgcaggaacatcggcttcgtctcaaatgatgtgggactggatgccgacaactgcaaggtcctccgtcaacattgagcagcagagccctgatattgctcaaggtgtacacgggcaacttaccaaaaaacctgaagaaattngtgctggtgaccaaggtcacattttgggtaatnccactggntgnaaaccccngnatttatgncccattgaccnagttcttnncaaa

SEQ ID NO: 1669 - DNA, 419 bp, Glycine max
  unsure (1)..(419): unsure at all n locations
cgagcttgagcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgagaagattgtgcgtgacacatgcaggaacattggttttgtctctgatgatgttgggtcttgatgctgacaactgcaaggtcctngtcaacattgagcaacagaatcctgatattgct

SEQ ID NO: 1670 - DNA, 447 bp, Glycine max
  unsure (1)..(447): unsure at all n locations
nccacgcgtccgagcgagtgttctttnttcgtttcaacaccttaatttgcacacgctgnntcttcagcnggngaaatggcacangaaacctttctattcacatctgaatctgnaaacgagggtcaccccgacaagctgtgcgaccagatctctgatgcagngctcgatgcgtgccttgaacaggaccctgacagcaaggttgcctgtgagacatgcaccaagaccaacatggtcatggtctttggagagatcacaaccaaggccaacgtagactatgagaagattgtccgtgacacatgccgngaaattggattcatctctgatgatgttggtcttgatgctgacaaatgcaaggngttggtcaacattgaacancaaanccctgatatcnccagggngngcacggncacttcaccaacccccaaaagaaggttnggctnggnncca

SEQ ID NO: 1671 - DNA, 517 bp, Glycine max
  unsure (1)..(517): unsure at all n locations
ggnnaggcttngtcnncgangggggatgtaatggnaacctctagaagactatgacgtcgcatgcacgcgtacgtaagctcggaattcggctcgagcaccacaccactctctctgctcttcttctacctttnaagnntttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccaaggccaacgttgactaccgaagaagatccgtgcgtgacacctgcaggaacatcggcttcgtctcaaacgatgtgggacttgatgctgacaactgcaaggtccttgtaaacattgagcagcagagccctgatattgcccagggtgtgcacggncaccttaccaaaagacccgaggaaatcggtgctg

SEQ ID NO: 1672 - DNA, 492 bp, Glycine max
  unsure (1)..(492): unsure at all n locations
aactttaccctccaggtngcngtcaaagaattcacgggtcgacccacgcgtccgtacggctgcgaagaagacgacagaagggggcaccgcttgagcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcggtgcatgcttggagcaggaccctgacagcaaggttgcctgtgaaacctgcaccaagaccaacatggtgatggttttcggagagatcacaaccaaggccaacgtggactatgagaagattgtgcgtgacacatgcaggaacattggttttgtctctgatgatgttggtcttgatgctgacaactgcaaaggtcctcgtcaacattgagcaacaaaat

SEQ ID NO: 1673 - DNA, 503 bp, Glycine max
  unsure (1)..(503): unsure at all n locations
gngntgnngcaactcnactnnccaggcctggtcacagaatnaacgggccganncacgcgtcnaagaccaaagccccactcaaacaacacaccaatctctctgctcctcctcnaactttcaagtttttaaagtnttaaagatggcagagacattcctaattnacctcagagtcagtgaacgagggacaccctgacaagctctgcgaccaaatctccgatgctgtcctcnacgcttgccttgaacaggacccagacagcaangttgcctgcgaaacatgcaccaagaccaacttggtcatggtcttcggagagatnaccancaaggccaacgttgactacgagaagatngtgcgtgacacctgcangaacatcggcttcgtctcaaacgatgtgggacttgatgctgacaactgcaaggtccttgtaaacattgagcaacaaaaccctgatattgcccaaggtgtncacggccaacttaccaaaaganccgaaggaaatcngtgc

SEQ ID NO: 1674 - DNA, 508 bp, Glycine max
  unsure (1)..(508): unsure at all n locations
ggncnnnngantgatttaggttcctangccacanaaatgnaactgacctcgcncgcacgcntacgtaagctcggaattcggctcgaggtggactatgagaagattgtgcgtgacacatgcaggaacattggttttgtctctgatgatgttggtcttgatgctgacaactgcaaggtcctcgtcaacattgagcaacagagtcctgatattgctcaaggtgtgcacggccacctcacaaagaggcctgaggagattggtgctggtgaccaaggtcatatgttcggctatgccactgacgagactcccgagctcatgcccttgagccatgtccttgccacgaagctcggtgccaagctcancgacggtccggaaaaacnggaaatgcccttgggctgaaaacctgatggcaannaccaagtcactgttgnnntactacaattgacaagggttccatggttccaatccgcgtcaaaactgttgctcatntccaanacagcaatgatngaga

SEQ ID NO: 1675 - DNA, 334 bp, Glycine max
  unsure (1)..(334): unsure at all n locations
gccttttcagggaaggaccctaccaaggttgacagnagtggtgcctatattgtaaggcaggctgcaaagagtgtcgtggcaaatggccttgctagaaggtgcattgtgcaagtttcctatgccattggtgtccctgagcccttgtcagtgtttgtggacacttatggaactgggaagattcctgacaaggagattctgcaaattgtgaaggagaatttcgacttcagacctggaatgatcaccattaacttggaccttaagaggggtggtcataggttcctcaagacagctgcttatggacactttggaagggatgatgcagacttcacctggg

SEQ ID NO: 1676 - DNA, 335 bp, Glycine max
  unsure (1)..(335): unsure at all n locations
agtcgcatgcacgcgtacgtaagctcggaattcggctcgaggcaaggttgcctgtgaaacctgcaccaagaccaacatggtgatggttttcggagagatcacaaccaaggccaacgtggactatganaagattgtgcgtgacacatgcaggaacattggtnttgtctctgatgatgttggtcttgatgctgacaactgcaaggtcctcgtcaacattgagcaacagagtcctgatattgctcaaggtgtgcacggccacctcacaaagaggcctgnggagattggtgctggtgaccaaggtcatatgttcggctatgccactgacgagactcccg

SEQ ID NO: 1677 - DNA, 337 bp, Glycine max
  unsure (1)..(337): unsure at all n locations
aaagatgcctgaggagattggtgctggtgaccaaggtcatatgttcggctatgccactgacgagactcccgatctcatnncttgagccatgtccttgccacgaagctcggngccaagctcaccgaggttcgnaagaacgggacatgcccttggctgagacctgatggcaagacccaagtcactgttgagtactacaatgacaagggtgccatggttccaatccgcgtccacactgtgctcatctccacacagcatgatgagccctgtcacaaatgatgagattgcagctgatcttaaagaacacgtgantaagcctgtgattcctgagaagtacctt

SEQ ID NO: 1678 - DNA, 448 bp, Glycine max
  unsure (1)..(448): unsure at all n locations
ccacgcgtccgcccacgcgtccgcccacgcgtccggtggacttgccagaaggtgcattgtgcaagtgtcttatgccattggtgtgcctgagcctttgtctgtgtttgttgacacctatggcactgggaagatccatgataaggagattctcaacattgtgaaggaaaactttgatttcaggcctggtatgatctccatcaaccttgatctcaagaggggtggaaataacaggtttttgaagactgctgcctatggacactttggaagagaagaccctgacttcacatgggaagtggtcaaacccctcaagtgggagaaggcctaagtaattcattccactgctctatgctggaagttttttgagcgttgcccttataatatgtctaatatccataactttccacgtctcttactctgtgtgtttctctcctnttnctctattttggta

SEQ ID NO: 1679 - DNA, 336 bp, Glycine max
  unsure (1)..(336): unsure at all n locations
tgcangcgtacgtaagctcggaattcggctcgagnctgctaagcagcattgtggcaagtggacttgccagaaggtgcattgtgcaagtgtcttatgccattggtgtgcctgagcctttgtctgtgtttgttgacacctatggcactgggaagatccatgataaggagattctcaacattgtgaaggaaaactttgatttcaggcctggtatgatctccatcaaccttgatctcaagaggggtggaaataacaggtttttgaagactgctgcctatggacactttggaagagaagaccctgacttcacatgggaagtggtcaaacccctcaantggg

SEQ ID NO: 1680 - DNA, 493 bp, Glycine max
  unsure (1)..(493): unsure at all n locations
gnnnnnnngaatgattngnttcntgccnnnnnnnnnnnnnnnnnnnnnnnnnnnnnnnnnnnnnnnnnnnnnnnnnnnnnnnnnnnnnnncccactcaaccaccacaccactctctctgctcttcttctacctttcangtttttacagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccaaggccaacgttgactacgagaagatcgtgcgtgacacctgcaggaacatcggcttcgtctcaaacgatgtgggacttgatgctgacaactgcaaggtccttgttaacattgagcaacaaaaccctgataattgccaagggtttgcacggccacctta

SEQ ID NO: 1681 - DNA, 340 bp, Glycine max
  unsure (1)..(340): unsure at all n locations
agtcgatgcacgcgtacgtaagctcggaattcngctcgagntgccgcgaaattggattcatctctgatgatgttggtcttgatgctgacaaatgcaaggtgttggtcaacattgagcaacagagcccggatatcgcccagggtgtgcacggccacttcaccaagcgcccagaggaggttggtgctggtgaccagggtcacatgtttgggtatgccaccgatgaaacccccgagtacatgcccctcagccatgtccttgcaaccaaacttggtgctcgcctcacagaggttaggaagaatggcacctgtgcttggttgaggccagatggtaagacacaagt

SEQ ID NO: 1682 - DNA, 317 bp, Glycine max
  unsure (1)..(317): unsure at all n locations
cgtnagctcggaattcggctcgagctgtgaccagatctccgatgctgtgctcgatgcatgcttggagcaggaccctgacagcaaaggttgcctgtgaaacctgcaccaagaccaacatggtgatggttttcggagagatcacaaccaaggccaacgtggactatgagaagattgtgcgtgacacatgcaggaacattggttttgtctctgatgaanttggtcttgatgctgacaactgcaaggtcctcgtcaacattgagcaacagagtcctgatattgctcaaggtgtgcacggccacctcacaaagaggcctgag

SEQ ID NO: 1683 - DNA, 406 bp, Glycine max
gagaagacgacagaagggggcagcgcttgagaccaagccccactcaaccaccacaccactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccaaggccaacgttgactacgagaagatcgtgcgtgacacctgcaggaacatcggcttcgtctcaaacgatgtgggacttgatgctgacaactgcaaggtccttgttaacattgagcaacaaaag

SEQ ID NO: 1684 - DNA, 489 bp, Glycine max
  unsure (1)..(489): unsure at all n locations
actccaccgcgncggtaccgttntaagnccccgggccgacaaacgcgtcagtccggctgcgagaagacgacagaaggggcaccgcttgagcagacttaacaacagcacaaagcgggttactgtctgttcaagctaccatctctctctctctttcttagtgccttcttgccagaagttaaaatggcccaagaaactttcctattcacatctgaatcagtgaacgaggggcaccctgacaagctctgtgaccagatctccgatgctgtgctcgatgcatgcttggagcangaccctgacagcaaggttgcctgtgaaacctgcaccaagaccaacatggtgatggttttcggagagatnacaaccaagggcaacgtggactatgagaagattgtgcgtgacacatgcaagaacattggttttgtctctgatgaagttggtcctgatgctgacaactgcaanggtctcgttcaacattgcagccancaagat

SEQ ID NO: 1685 - DNA, 506 bp, Glycine max
  unsure (1)..(506): unsure at all n locations
gtggnnnngggnnaactttnaccngccangggccggtanagaattaacggctcganccacgcgtcaagtacggctgcnagaagacgacagaaggggatgaaacccctgagtacatgcccctcagccatgtccttgcaaccaaactcggtgctcgcctcaccgaggttaggaaaaatggtacctgtgcttggctgaggccagatggcaagacacaagtaactgttgagtactacaatgacaatggtgccatggttccagttcgtgtccacactgtcctaatttccacccaacatgttgagactgtgagcaatgaccaaattgctgctgaccttaaagaacatgttatcaagcctgtcattcctgagaagtncctggatgagaagaccatcttccaaccttaaaccttctgggcgtttttgncnnttggtgggccccnanggtganncccgggcccanatgggaaannaaagatttccccntggaaacccanaggttggngngggntc

SEQ ID NO: 1686 - DNA, 427 bp, Glycine max
  unsure (1)..(427): unsure at all n locations
gaggccaggcaagccccactcaaccaccacacctctcctcggttcacgcctaccctttctgctcttcttcnacctttcaagttttaaaagtataaagatggcanagacattcctatttacctcagagtcggtgaacgagggacaccctgacaagctctgcgaacaaatctccgatgctgtcctcgacgcttgcctcgagcaggacccanacagcaaagttgcctgcgaaacatgcaccaaaaccaacttggtcatggtcttcggagaaatcacgaccaaggccaacgttgactacgagaagatagtgcgtgacacctgcaggaacatcggcttcgtctcaaatgatgtgggactgggatgccgacaactgcaaggtcctcgtcaacattgagcancaganccctgatattgcccanggtgtacacgg

SEQ ID NO: 1687 - DNA, 504 bp, Glycine max
  unsure (1)..(504): unsure at all n locations
ggnaactcttcgcggccaaactcttacannnccaggtagngntanangaattcccggctcgacccacgcgtnacgtacggctgcgagaagacgacagaagggggcagcgcttgagaccaagccccactcaaccaccacaccactctctctgctcttcttctacctttcaagtttttaaagtattaagatggcagagacattcctatttacctcagagtcggtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccaaggccaacgttgactacgangagatcgtgcgtgacacctgcaggaacatcggcttcgtctcaaacgatgtgggacttgatgctgacaactgcaaggtccttgtaaacattgaagcagcagagccctgatattgccc

SEQ ID NO: 1688 - DNA, 323 bp, Glycine max
  unsure (1)..(323): unsure at all n locations
ncgnangcacgcgtacgtnagctcggaattcggctcgagnctgaatcngtgaacgaggggcaccctgancaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgagaagattgtgcgtgacacatgcaggaacattggttttgtctctgatgatgttggtcttgatgctgacaactgcaaggtcctcntcaacattgagcaacagagtcctg

SEQ ID NO: 1689 - DNA, 296 bp, Glycine max
  unsure (1)..(296): unsure at all n locations
tcggctcgagngaccatcttccaccttaacccttctggccgttttgtcattggtggccctcatggtgatgctggtctcactggaagaaagatcatcattgatacctatggtggctggggtgctcatggtggaggtgccttttcagggaaggaccctaccaaggttgacagaagtggtgcctatattgtaaggcaggctgcaaagagtgtcgtggcaaatggccttgctagaaggtgcattgtgcaagtttcctatgccattggtgtccctgagcccttgtcagtgtttgtggacac

SEQ ID NO: 1690 - DNA, 303 bp, Glycine max
gcacgcgtacgtaagctcggaattcggctcgagtatgagaagattgtccgtgacacatgccgcgaaattggattcatctctgatgatgttggtcttgatgctgacaaatgcaaggtgttggtcaacattgagcagcagagccctgatatcgcccagggtgtgcacggtcacttcaccaagcgcccagaggaggttggtgctggtgaccagggtcacatgtttggctatgccactgatgaaacccctgagtacatgcccctcagccatgtccttgcaaccaaactcggtgctcgcctcaccgag

SEQ ID NO: 1691 - DNA, 336 bp, Glycine max
  unsure (1)..(336): unsure at all n locations
gncnatccaaagcgtacgtaagctcggaattcggctcgagggaacatcggcttcgtctcaaatgatgtgggactggatgccgacaactgcaaggtcctcgtcaacattgagcagcagagccctgncattgctcagggtgtacacggccaccttaccaaaaaacctgaagaaattggtgctggtgaccagggtcacatgtttggctatgccactgatgaaacccctgaattgatgccattgagccatgttcntgcaacaaaactcggtgctcgtctcaccgaggttcgcaagaacggtacctgcccttggctgaggcctgatgggaagacccaagtg

SEQ ID NO: 1692 - DNA, 314 bp, Glycine max
  unsure (1)..(314): unsure at all n locations
tcgcatgcncgcgtacgtnagctcggaattcggctcgaggttaaaatggcccaaganactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgagaagattgtgcgtgacacatgcaggaacattggttttgtctctgatgatgttggtcttgatgctga

SEQ ID NO: 1693 - DNA, 321 bp, Glycine max
  unsure (1)..(321): unsure at all n locations
gtcgcangcacgcgtacgtaagctcggaattcggctcgagtcattatcgatacttatggaggatggggtgctcatggtggtggtgctttctccgggaaggaccctaccaaggttgataggagtggtgcttacattgtgagacaggctgctaagagcattgtggcaagtggacttgccagaaggtgcattgtgcaagtgtcttatgccattggtgtgcctgagcctttgtctgtgtttgttgacacctatggcactgggaagatccatgataaggagattctcaacattgtgaaggaaaactttgatttcaggcctggtata

SEQ ID NO: 1694 - DNA, 514 bp, Glycine max
  unsure (1)..(514): unsure at all n locations
gngnnnnagtggntngtgnagtnnactnagnnaaattttgnaccggtccggaattcccgggtcgacccacgcgtccgtacgagaagacgacagaagggggcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacgagaagatagtgcgtgacacctgcaggaacatcggcttcgtctcaaatgatgtgggactggatgccgacaactgcaaggtcctcgtcaacattgagcagcagaccct

SEQ ID NO: 1695 - DNA, 434 bp, Glycine max
  unsure (1)..(434): unsure at all n locations
agagaccaagccccactcaaccaccacaccactctctctgctcttcttcnacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccaaggccaacgttgactacnagaagatcgtgcgtgacacctgcaggaacatcggcttcgtctcaaacgatgtgggacttgatgctgacaactgcaaggtccttggnaacnttgagcaacaaaanccctgataattgccaaggtgtgcaagggcaactttacaaaaagacccganggaat

SEQ ID NO: 1696 - DNA, 328 bp, Glycine max
  unsure (1)..(328): unsure at all n locations
ttcgctgcacgcntacgtnagctcggnaattcggntcgagngcntacattgtgagacaggctgctaagagcattgtggcaagtggactagccagaaggtgcattgtgcaagtgtcttatgccattggtgtgncccgagcctttgtctgtctttgttgacacctatggcaccgggaagatccatgataaggagattctcaacattgtgaaggagaactttgatttcaggcccggtatgatctccatcaaccttgatctcaagaggggtgggaataacaggttcttgaagactgctgcatatggacacttcggcagagaggaccctgact

SEQ ID NO: 1697 - DNA, 496 bp, Glycine max
  unsure (1)..(496): unsure at all n locations
aactcttacgtngccaggnnccggtanagaattaccggggncgacccacgcgtcngcccacncgtccgcccacgcgtccgacggctgcgagaagacgacagaaggggggcagcgcttgagaccaagccccactcaaccaccacaccactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatnaccaccaaggccaacgttgactacgagaagatcgtgcgtgacacctgcaggaacatcggcttcgtctcaaacgatgtgggactgatgctgacaactgcaaagtccttgttaacaatgaacancaaanccc

SEQ ID NO: 1698 - DNA, 300 bp, Glycine max
  unsure (1)..(300): unsure at all n locations
cgcatgcacgcgtacgtnagctcggaattcggctcgagggagtggtgcctacattgtgaggcaagctgcaaagagcattgttgcaaatggacttgctaggagggcaattgtgcaagtttcctatgccattggtgtgcctgagcccttgtctgtgtttgttgacacttatggcactgggaagatccctgacaaggaaatcctcagcattgtgaaggagagttttgacttcaggcctggcatgatctccatcaaccttgatctcaagaggggtggaaatggcaggttcttgaagactgctgc

SEQ ID NO: 1699 - DNA, 303 bp, Glycine max
  unsure (1)..(303): unsure at all n locations
acntnctgcacgcgtacgtaagctcggaattcggctcgaggtcatggtctttggagagatcacaaccaaggccaacgtagactatgagaagattgtccgtgacacatgccgcgaaattggattcatctctgatgatgttggtcttgatgctgacaaatgcaaggtgttggtcaacattgagcagcagagccctgatatcgcccagggtgtgcacggtcacttcaccaagcgcccagaggaggttggtgctggtgaccagggtcacatgtttggctatgccactgatgaaacccctgagtacat

SEQ ID NO: 1700 - DNA, 311 bp, Glycine max
  unsure (1)..(311): unsure at all n locations
ncgcnngcacgcntacgtnagctcggaattcggctcgacgcaccaagaccaacatggtgatggttttcggagagatcacaaccaaggccaacgtggactatgagaagattgtgcgtgacacatgcaggaacattggtnttgtctctgatgatgttggtcttgatgctgacaactgcaaggtcctcgtcaacattgagcnacagagtcctgatattgctcaaggtgtgcacgnccacctcacaaagaggcctgaggagattggtgctggtgaccaaggtcatatgttcggctatgccactgacgagactccc

SEQ ID NO: 1701 - DNA, 425 bp, Glycine max
  unsure (1)..(425): unsure at all n locations
gagtaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgagaagattgtgcgtgacacatgcaggaacattggttttgtcccgatgatgtttggtcctgatgctgacaactgcaangtcccccgtcaacaatgagcaacanagtccctgaaaattgcncaangngttgnacgggc

SEQ ID NO: 1702 - DNA, 321 bp, Glycine max
  unsure (1)..(321): unsure at all n locations
tgcncgcgtacgtaagctcggnatttnggctcgaagcattgtggcaagtggactagccagaaggtgcattgtgcaagtntcttatgccattggtgtgcccgagcctttgtctgtctttnttgacacctatggcaccgggnagatccatgataaggagattctcnacattgtgaaggagaactttgatttcaggcccggtatgatctccatcaaccttgatctcaagaggggtgggnataacaggttcttgaagactgctgcatatggncacttcggcagagaggaccctgacttcacatgggaagtggtcnagcccctcaa

SEQ ID NO: 1703 - DNA, 311 bp, Glycine max
  unsure (1)..(311): unsure at all n locations
tcgcangcacgcntacgtaagctcggaattcggctcgagcggctcgaggtagactatgagaagattgtccgtgacacatgccgcgaaattggattcatctctgatgatgttggtcttgatgctgacaaatgcaaggtgttggtcaacattgagcagcagagccctgatatcgcccagggtgtgcacggtcacttcaccaagcgcccagaggaggttggtgctggtgaccagggtcacatgtttggctatgccactgatgaaacccctgagtacatgcccctcagccatgtccttgcgcccaaactcggtgn

SEQ ID NO: 1704 - DNA, 473 bp, Glycine max
  unsure (1)..(473): unsure at all n locations
ttaacttgcncgcgccaggtancggtcaaggaattcccgggtcgacccacgcgtccgacggctgcgagaagacgacagaagggggcagcgcttganaccaagccccactcaaccaccacaccactctctctgctcttcttctacctttcaagtttttaaagtantaagatggcagagacattcctatttacctcanagtcagtgaacgagggacaccctgacaagctctgcgaccaaatctccgatgctgtcctcgacgcttgccttgaacaggacccagacagcaaggttgcctgcgaaacatgcaccangaccancttggtcatgggtcttcggagagatcaccaccaaggccaacgttgactacgagaagatcgtgcgtgacacctgcaggaacatcggcttcgtctcaaacgatgtgggacttgatgctgacaactgcaaggtccttgtaaacattgagcagcagagcc

SEQ ID NO: 1705 - DNA, 319 bp, Glycine max
gcacgcgtacgtaagctcggaattcggctcgagcaagtaactgttgagtactacaatgacaatggtgccatggttccagttcgtgtccacactgtcctaatttccacccaacatgatgattctgtgagcaatgaccaaattgctgctgaccttaaagagcatgttatcaagcctgtcattcctgagaagtacctggatgagaagaccatcttccaaccttaacccttctggccgttttgtcattggtggccctcatggtgatgctggtctcactggaagaaagatcatcattgatacctatggtgggtggggtgctcat

SEQ ID NO: 1706 - DNA, 507 bp, Glycine max
  unsure (1)..(507): unsure at all n locations
gnnnnnnaantctacgccgcccctctaacgngcacaanattcncgggaacgacccacgcgnccgtacggctgcgaagaagacgacagaagggggcagcgcttgagancaanccccactcaaccaccacaccactctctctgctcttcttcnanctttcaagtttttaaagtattaagatggcagagacattcctatttacctcagagtcagtgaacgagggacaccctgacaagctctgcgaccaaatctccgatgctgtcctcgacgcttgcctttaaacangacccaagacagcaaagttgcctgcgaaacatgcaccaagaccaacttggtcatggtcttcggagagatnaccaccaagggcaacgttgactacgagaagatcgtgcgtgacacctgcaggaacatcggcttcgtctcaaacgatgtgggacttgatgctgacaactgcaangtccttgtaaacattgagcaacaaaaccctganaatncccaaggtttcaccg

SEQ ID NO: 1707 - DNA, 351 bp, Glycine max
ccttttcagggaaggaccctaccaaggttgacagaagtggtgcctatattgtaaggcaggctgcaaagagtgtcgtggcaaatggccttgctagaaggtgcattgtgcaagtttcctatgccattggtgtccctgagcccttgtcagtgtttgtggacacttatggaactgggaagattcctgacaaggagattctgcaaattgtgaaggagaatttcgacttcagacctggaatgatcaccattaacttggaccttaagaggggtggtcataggttcctcaagacagtgcttatggacactttggaagggatgatgcagcttcactgggaagtgtgaaccactcaagtca

SEQ ID NO: 1708 - DNA, 509 bp, Glycine max
  unsure (1)..(509): unsure at all n locations
ggngnnnnnggnnnnnnngnnaacttttacgccngtccgtgccggtcanagaattcacgggncgacncacgcgtccncccacgcgtccgcccacgcgtccgcccacgcgtccgctgcgagaagacgacagaagggggcagcgcttgagaccaagccccactcaaccaccacaccactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccaaggccaacgttgactacgagaagatcgtgcgtgacacctgcaggaacatcggcttcgtctcaaacgatgtgggacttgatgctgacaactgcaaggtccttgtnaaca

SEQ ID NO: 1709 - DNA, 267 bp, Glycine max
gagacaggctgctaagagcattgtggcaagtggacttgccagaaggtgcattgtgcaagtgtcttatgccattggtgtgcctgagcctttgtctgtgtttgttgacacctatggcactgggaagatccatgataaggagattctcaacattgtgaaggaaaactttgatttcaggcctggtatgatctccatcaaccttgatctcaagaggggtggaaataacaggtttttgaagactgctgcctatggacactttggaagagaaga

SEQ ID NO: 1710 - DNA, 320 bp, Glycine max
  unsure (1)..(320): unsure at all n locations
acgtcgcangcacgcgtacgtaagctcggaattcggctcgaggcagcagagccctgatatcgcccagggtgtgcacggtcacttcaccaagcgcccagaggaggttggtgctggtgaccncggtcacatgtttggctatgccactgatgaaacccctgagtacatgcccctcagccatgtccttgcaaccaaactcggtgctcgcctcaccgaggttaggaaaaatggtacctgtgcttggctgaggccagatggcaagacacaagtaactgttgagtactacaatgacaatggtgccatggttccagttcgtgtccaca

SEQ ID NO: 1711 - DNA, 330 bp, Glycine max
  unsure (1)..(330): unsure at all n locations
nnnaaaanntgacntcgcangcacgcgtacgtaagctcggaattcggctcgagggactggatgccgacaactgcaaggtcctcgtcaacattgagcagcagagccctgatattgctcagggtgtacacggccaccttaccaaaaaacctgaagaaattggtgctggtgaccagggtcacatgtttggctatgccactgatgaaacccctgaattgatgccattgagccatgttcttgcaacaaaactcggtgctcgtctcaccgaggttcgcaagaacggtacctgcccttggctgaggcctgatgggaagacccaagtgaccgttgagt

SEQ ID NO: 1712 - DNA, 313 bp, Glycine max
  unsure (1)..(313): unsure at all n locations
agtngcangcacgcgtacgtaagctcggaattcggctcgagtgcaagtttcctatgccattggtgtgcctgagcccttgtctgtgtttgttgacacttatggcactgggaagatccctgacaaggaaatcctcagcattgtgaaggagagttttgacttcaggcctggcatgatctccatcaaccttgatctcaagaggggtggaaatggcaggttcttgaagactgctgcatatggacactttggcagagatgaccctgacttcacatgggaagtggtgaagccactcaagggggagaaggtacctgcttac

SEQ ID NO: 1713 - DNA, 486 bp, Glycine max
  unsure (1)..(486): unsure at all n locations
gttaactttcccgcgccnggtcangaataaacgggtcganccacgcgtccgacggatgcgagaagacgacagaagggggcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacgagaagatagtgcgtgacacctgcangaacatcggcttcgtctcaaatgatgtgggactggatgccgacaactgcaaggtcctcgtcaacattgagcaac

SEQ ID NO: 1714 - DNA, 474 bp, Glycine max
  unsure (1)..(474): unsure at all n locations
aactttacgctgccangtnccggtcanagaattnacggggccgacccacgcgtccntacggctgcgagaagacgacagaagggggcagcgcttgagaccaagccccactcaaccaccacaccactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccaaggccaacgttgactacganaagatcgtgcgtgacacctgcaggaacatcggcttcgtctcaaacgatgtgggacttgatgctgacaactgcaaaggtcctttgtaaacattgagcaacanagnc

SEQ ID NO: 1715 - DNA, 382 bp, Glycine max
  unsure (1)..(382): unsure at all n locations
gtcgcangcacgcgtacgtaagctcgggaattcgggctcgagcaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgagaagattgtgcgtgacacatgcaggaacattggttttgtctctgatgatgttggtc

SEQ ID NO: 1716 - DNA, 308 bp, Glycine max
  unsure (1)..(308): unsure at all n locations
nntcgcangcacgcgtacgtaagctcggaattcggctcgagggcaccctgnacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgagaagattgtgcgtgacacatgcaggaacattggttttgtctctgatgatgttggtcttgatgctgacaactgcaaggtcctcgtcaacattgagcaacagagtcctgat

SEQ ID NO: 1717 - DNA, 312 bp, Glycine max
  unsure (1)..(312): unsure at all n locations
gtcnnangcacgcgtacgtaagctcggaattcggctcgagccagatctccgatgctgtgctcgatgcatgcttggagcaggaccctgacagcaaggttgcctgtgaaacctgcaccaagaccaacatggtgatggttttcggagagnncacaaccaaggccaacgtggactatgagaagattgtgcgtgacacatgcaggaacattggttttgtcnctgatgatgttggtcttgatgctgacaactgcaaggtcctcgtcaacattgagcaacagagtcctgatattgctcaaggtgtgccggccacctcac

SEQ ID NO: 1718 - DNA, 315 bp, Glycine max
  unsure (1)..(315): unsure at all n locations
gtcgcangcacgcgtacgtaagctcgggaattcggctcgaggcgctggtgaccagggtcacatgtttggctatgccactgatgaaaccccagaattcatgccattgagtcatgttcttgcaaccaagctcggtgctcgtctcaccgaggttcgcaagaacggaacctgcccatggctgaggcctgatgggaagacccaagtgactgtggagtattacaatgataatggtgccagggttccagttcgtgttcacaccgtgctaatctccacccagcatgatgagactgtcaccaacgacgaaattgcggctgacct

SEQ ID NO: 1719 - DNA, 312 bp, Glycine max
  unsure (1)..(312): unsure at all n locations
ggaattcggctcgagctgttgagtactacaatgacaatggtgccatggttccagttcgtgtccacactgtcctaatttccacacaacatnanaaggnngtgagcaatgaccaaattgctgctgaccttaaagagcatgttatcaagcctgtnantcctgagaagtacctggatgagaagaccatcttcnaccttaacccttctggccgttttgtcattggtggccctcatggtgatgctggtctcatggaagaaagatcatcattgatacctatggtgggtggggtgctcatggtggaggtgcttttcaggg

SEQ ID NO: 1720 - DNA, 311 bp, Glycine max
  unsure (1)..(311): unsure at all n locations
gtcgcangcacgcgtacgtaagctcggaattcggctcgagctcgagccgaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgagaagattgtgcgtgacacatgcaggacattggttttgtctctgatgatgttggtcttgatgctgacaat

SEQ ID NO: 1721 - DNA, 327 bp, Glycine max
  unsure (1)..(327): unsure at all n locations
gtcgcangcacgcnnncgtnnagctcggaattcggctcgagnacgagggngcaccctgacangctctgtgaccagatctccnatgctgtgctcgatgcatgcttggagcaggaccctgacagcaaggttgcctgtgaaacctgcaccaagaccaacatggtgatggttttcggagagatcacaaccaaggccaacgtggactatgagaagattgtgcgtgacacatgcaggaacattggtcttgtctctnatgatgttggtcttgatgctgacaactgcaagtcctcgtcaacantgagcnacagagtcctgatattnntccaggng

SEQ ID NO: 1722 - DNA, 308 bp, Glycine max
  unsure (1)..(308): unsure at all n locations
gtcgcngcacgcgtacgtaagctcggaattcggctcgagcaggaccctgacagcaaggttgcctgtgagacatgcaccaagaccaacatggtcatggtcttcggagagatcacaaccaaggccaacgtagactatgaaaagattgtccgcgacacatgccgcgaaattggattcatctctgatgatgttggtcttgatgctgacaaatgcaaggtgttggtcaacattgagcaacagagcccggatatcgcccagggtgtgcacggccattcaccaagcgcccagaggaggttggtgccggtgaccag

SEQ ID NO: 1723 - DNA, 290 bp, Glycine max
tagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgagaagattgtgcgtgacacatgcaggaacattggtttgtctctgatgatgttggtcctgatgc

SEQ ID NO: 1724 - DNA, 325 bp, Glycine max
  unsure (1)..(325): unsure at all n locations
tngcatgcacgcgtacgtaagctcggaattcggctcgagcaggacccagacagcaaggttgcctgcgaacatgcaccaagaccaacttggtcatggtcttcggagagatcaccaccaaggccaacgttgactacgagaagatcgtgcgtgacacctgcaggaacatcggcttcgtctcaaacgatgtgggacttgatgctgacaactgcaaggtccttgtaaacattgagcagcagagccctgatattgcccagggtgtgcacggccaccttaccaaaagacccgaggaaatcggtgctggagaccagggtcacatgtttggcta

SEQ ID NO: 1725 - DNA, 486 bp, Glycine max
  unsure (1)..(486): unsure at all n locations
ggnnnnnnnnnttnnnnngcccttttacgcgccaaggtaccggtcaaggaattcccggntcgacccacgcgtcngacggctgcgagaagacgacagaagggggcagcgcttgagaccaagccccactcaaccaccacaccactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccaaggccaacgttgactacgagaagatcgtgcgtgacacctgcaggaacatcggcttcgtctcaaacgatgtgggacttgatgctgacaactgcaaggtcccttgtaaacattganncagc

SEQ ID NO: 1726 - DNA, 308 bp, Glycine max
  unsure (1)..(308): unsure at all n locations
cangcacncgtacgtnagctcggaattcggctcgagngcacggccacctcacaaagaggcctgaggagattggtgctggtgaccaaggtcatatgttcggctatgccactgacgagactcccgagctcatgcccttgagccatgtccttgccacgaagctcggtgccaagctcaccgaggttcggaagaacgggacatgcccttggctgagacctgatggcaagacccaagtcactgttgagtactacaatgacaagggtgccatggttccaatccgcgtccacactgtgctcatctccacacagcat

SEQ ID NO: 1727 - DNA, 307 bp, Glycine max
  unsure (1)..(307): unsure at all n locations
cgtcgcatgcacgcgtacgtaagctcggaattcggctcgagttttcggagagatcacaaccaaggccaacgtggactatgagaagattgtgcgtgacacatgcaggaacattggttttgtctctgatgatgttggtcttgatgctgacaactgcaaggtcctcgtcaacattgagcaacagagtcctgatattgctcaaggtgtgcacggccacctcacaaanaggcctgaggagattggtgctggtgaccaaggtcatatgttcggctatgccactgacgagactcccgagctcatgcccttgagc

SEQ ID NO: 1728 - DNA, 313 bp, Glycine max
  unsure (1)..(313): unsure at all n locations
acgtcgcangcacgcgtacgtaagctcggaattcggctcgagnaggctgctaagagcattgtngcaagtggacttgccagaaggtgcattgtgcaagtntcttatgccattggtgtgcctgagcctttgtctgtgtttgttgacacctatggcactgnnaagatccatgataaggagattctcaacattgtgaaggaaaactttgatttcaggcctggtatgatctccatcaaccttgatctcaagaggggtggaaataacaggtttttgaagactgctgcctatggacactttggaagagaagacctgactt

SEQ ID NO: 1729 - DNA, 320 bp, Glycine max
  unsure (1)..(320): unsure at all n locations
agtcgcatgcacgcgtacgtaagctcggaattcggctcgagatggtcttcggagagatcacaaccaaggccaacgtagactatgaaaagattgtnccgcgacacatgccgcgaaattggattcatctctgatgatgttggtcttgatgctgacaaatgcaaggtgttggtcaacattgagcaacagagcccggatatcgcccagggtgtgcacggccacttgcaccaagcgcccagaggaggttggtgctggtgaccagggtcacatgtttgggtatgccaccgatgaaacccccgagtacatgcccctcagccatgtcc

SEQ ID NO: 1730 - DNA, 361 bp, Glycine max
  unsure (1)..(361): unsure at all n locations
gttaggttctgcacgctctgcttccagcgagtgttctttcttcgtttcaacaccttaatttgcatnacgctgctttcttnngacntgaggaatgggcacaagaaaccttttctattcacatctgaatctgtaaacgagggttcaccccgacaagctgtgcgaccagatctctgatgcagtgctcgatgcgtgccttgaacaggaccctgacagcaaggttgcctgtgagacatgcaccaagaccaacatggtcatggtctttgggagagatcacaaccaaggccaacgtagactatgagaagattgtccgtgacacatgccgcgaaattggattcatctctgatgatgttggtcttgatgc

SEQ ID NO: 1731 - DNA, 327 bp, Glycine max
  unsure (1)..(327): unsure at all n locations
gtcgcatgcacgcgtacgtaagctcgggaattcggctcgagtgcatgcttgggagcaggaccctgacagcaaggttgcctgtgaaacctgcaccaagaccaacatggtgatggttttcggagtcnatcacaaccaaggccaacgtggactatgagaagattgtgcgtgacacatgcacgaacattggttttgtctctgatgatgttggtcttgatgctgncaactgcaaggtcctcgtcaacattgagcaacagagtcctgatattgctcaaggtgtgcacggccacctcacaaagaggcctgaggagattggtgctggtgaccaan

SEQ ID NO: 1732 - DNA, 303 bp, Glycine max
  unsure (1)..(303): unsure at all n locations
cgtcgcangcacgcgtacgtaagctcggaattcggctcgagtaggagggcaattgtgcaagtttcctatgccattggtgtgcctgagcccttgtctgtgtttgttgacacttatggcactgggaagatccctgacaaggaaatcctcagcattgtgaaggagagttttgacttcaggcctggcatgatctccatcaaccttgatctcaagaggggtggaaatggcaggttcttgaagactgctgcatatgggacactttggcagagatgancctgacttcacatgggaagtggtgaagccact

SEQ ID NO: 1733 - DNA, 321 bp, Glycine max
  unsure (1)..(321): unsure at all n locations
ngtcgcangcacgcgtacgtaagctcggaattcggctcgagattgatacctatggtgggtggggtgctcatggtggaggtgccttttcagggaaggaccctaaccaaggttgacagaagtggtgcctatatcgtgaggcaggctgcaaagagtgttgtggcaaatggccttgccagaaggtgcattgtccaagtttcctatgccattggtgtccctgagcccttgtcagtgtttgtggacacttatggaactgggaagattcctgacaaggagattcttcaaattgtgaaggagaatttcgacttcagacctggaatgatc

SEQ ID NO: 1734 - DNA, 310 bp, Glycine max
  unsure (1)..(310): unsure at all n locations
gtcgcnngcacgcgtacgtaagctcggaattcggctcgagggacgagaccccagaattgatgccattgagtcatgttcttgcaactaaactcggtgctcgtctcaccgaggttcgcaagaacggaacctgcccatggttgaggcctgatgggaagacccaagtgactgttgagtattacaatgacaacggtgccatggttccagttcgtgtccacactgtgcttatctccacccaacatgatgagactgtgaccaacgacgaaattgcagctgacctcaaggagcatgtgatcaagccggtgatcccgga

SEQ ID NO: 1735 - DNA, 288 bp, Glycine max
  unsure (1)..(288): unsure at all n locations
ngtcgcatgcacgcgtacgtaagctcggaattcggctcgagtggtcatggtctttggagagatcacaaccaaggccaacgtagactntgagaagattgtccgtgacacatgccgcgaaattggattcatctctgatgatgttggtcttgatgctgacaaatgcaaggtgttggtcaacattgagcagcagagccctgatatcgcccagggtgtgcacggtcacttcaccaagcgcccagaggaggttggtgctggtgaccagggtcacatgtttggctatgccactga

SEQ ID NO: 1736 - DNA, 299 bp, Glycine max
  unsure (1)..(299): unsure at all n locations
gtcgcangcacgcgtacgtnagctcggnnttcggctcgagntcagtgaacgaggggcaccctgacaagctctgngaccagatctccgatgctgtgctcgatgcatgcttggagcaggaccctgacagcaaggttgcctgtnaaacctgcaccaagaccaacatggtgatggttttcggagagatcacaaccaaggccaacgtggactatgagaagattgtgcgtgacacatgcaggaacattggttttgtctctgatgatgttggtcttgatgctgacaactgcaaggtcctcnncaan

SEQ ID NO: 1737 - DNA, 328 bp, Glycine max
  unsure (1)..(328): unsure at all n locations
ngtcgcatgcacgcgtacgtaagctcggaattcggctcgaggcctgtcattcctgagaagtaccttgatgagaagaccatcttccaccttaacccttctggccgttttgtcattggtggccctcatggtgatgctggtctcactggaagaaagatcatcattgatacctatggtggctggggtgctcatggtggaggtgccttttcagggaaggaccctaccaaggttgacagaagtggtgcctatattgtaaggcaggctgcaaagagtgtcgtggcaaatggccttgctagaaggtgcttgtgcaagtttccctatgccatggtgc

SEQ ID NO: 1738 - DNA, 315 bp, Glycine max
  unsure (1)..(315): unsure at all n locations
tcncgcgtacgtnagctcggaattcggctcgagaccaagaccaacatggtgatggttttcggagagatcacaaccaaggccaacgtggactatgagaagattgtgcgtgacacatgcaggaacattggttttgtctctgatgatgttggtcttgatgctgacaactgcaaggtcctcgtcaacattgagcaacagagtcctgatattgctcaaggtgtgcacggccaccttcacaaagaggcctgaggagattggtgctggtgaccaaggtcatatgttcggctatgcccactgacgagactcccgagctcagcc

SEQ ID NO: 1739 - DNA, 303 bp, Glycine max
  unsure (1)..(303): unsure at all n locations
cccngcacgcgtacgtaagctcggaattcggctcgagcgatacttatggaggatggggtgctcatggtggtggtgctttctccgggaaggaccctaccaaggttgataggagtggtgcttacattgtgagacaggctgctaagagcattgtggcaagtggacttgccagaaggtgcattgtgcaagtgtcttatgccattggtgtgcctgagcctttgtctgtgtttgttgacacctatggcactgggaagatccatgataaggagattctcaacattgtgaaggaaaactttgattcaggcc

SEQ ID NO: 1740 - DNA, 299 bp, Glycine max
  unsure (1)..(299): unsure at all n locations
tctntgnancgtagtaagctcggaattcggctcgagctgatattgcccagggtgtgcacggccaccttaccaaaagacccgaggaaatcggtgctggagaccagggtcacatgtttggctatgccacggacgagaccccagaattgatgccattgagtcatgttcttgcaactaaactcggtgctcgtctcaccgaggttcgcaagaacggaacctgcccatggttgaggcctgatgggaagacccaagtgactgttgagtattacaatgacaacggtgccatggttccagttcgtgtc

SEQ ID NO: 1741 - DNA, 263 bp, Glycine max
cattgagcaacagagtcctgatattgctcaaggtgtgcacggccacctcacaaagaggcctgaggagattggtgctggtgaccaaggtcatatgttcggctatgccactgacgagactcccgagctcatgcccttgagccatgtccttgccacgaagctcggtgccaagctcaccgaggttcggaagaacgggacatgcccttggctgagacctgatggcaagacccaagtcactgttgagtactacaatgacaagggtgcca

SEQ ID NO: 1742 - DNA, 299 bp, Glycine max
  unsure (1)..(299): unsure at all n locations
gtngangcgtacgtaagctcggaattcggctcgaggcacggccacctcacaaagaggcctgaggagattggtgctggtgaccaaggtcatatgttcggctatgccactgacgagactcccgagctcatgcccttgagccatgtccttgccacgaagctcggtgccaagctcaccgaggttcggaagaacgggacatgcccttggctgagacctgatggcaagacccaagtcactgttgagtactacaatgacaagggtgccatggttccaatccgcgtccacactgtgctcatctccac

SEQ ID NO: 1743 - DNA, 254 bp, Glycine max
ctcaccgaggttcgcaagaacggtacctgcccttggctgaggcctgatgggaagacccaagtgaccgttgagtattacaatgacaatggtgccagggttcctattcgtgtacacaccgtgctaatctccacccaacacgacgagactgtcaccaatgacgaaattgctgctgacctcaaagagcatgtgatcaagcctgtgatcccagagaagtaccttgatgagaagaccattttccacttgaacccttcagg

SEQ ID NO: 1744 - DNA, 268 bp, Glycine max
acagagtcctgatattgctcaaggtgtgcacggccacctcacaaagaggcctgaggagattggtgctggtgaccaaggtcatatgttcggctatgccactgacgagactcccgagctcatgcccttgagccatgtccttgccacgaagctcggtgccaagctcaccgaggttcggaagaacgggacatgcccttggctgagacctgatggcaagacccaagtcactgttgagtactacaatgacaagggtgccatggttccaatccgc

SEQ ID NO: 1745 - DNA, 305 bp, Glycine max
  unsure (1)..(305): unsure at all n locations
gcacgcgtacgtaagctcggaattcggctcgagcacggacgagaccccagaattgatgccattgagtcatgttcttgcaactaaactcggtgctcgtctcaccgaggttcgcaagaacggaacctgcccatggttgaggcctgatgggaagacccaagtgactgttgagtattacaatgacaacggtgccatggttccagttcgtgnccacactgtgcttatctccacccaacatgatgagactgtgaccaacgacgaaattgcagctgacctcaaggagcatgtgatcaagccggtgatcccgg

SEQ ID NO: 1746 - DNA, 316 bp, Glycine max
  unsure (1)..(316): unsure at all n locations
antcgcangcacgcgtacgtaagctcggaattcggctcgaggtcctcgacgcttgccttgaacaggacccagacagcaaggttgcctgcgaaacatgcaccaagaccaacttggtcatggtcttcggagagatcaccaccaaggccaacgttgactacgagaagatcgtgcgtgacacctgcaggaacatcggcttcgtctcaaacgatgtgggacttgatgctgacaactgcaaggtccttgtaaacattgagcagcagagccctgatattgcccagggtgtgcacggccaccttaccaaaagacccgaggaaat

SEQ ID NO: 1747 - DNA, 306 bp, Glycine max
gtcgcatgcacgcgtacgtaagctcggaattcggctcgagctcaccggccgcaagatcatcatcgacacctatggaggatggggtgcacatggtggtggtgccttctctgggaaggatcctaccaaggttgataggagtggtgcctacattgtgaggcaagctgcaaagagcattgttgcaaatggacttgctaggagggcaattgtgcaagtttcctatgccattggtgtgcctgagcccttgtctgtgtttgttgacacttatggcactgggaagatccctgacaaggaaatcctcagcattgt

SEQ ID NO: 1748 - DNA, 269 bp, Glycine max
  unsure (1)..(269): unsure at all n locations
gtgcgtgacacatgcaggaacattggttttgtctctgatgatgttggtcttgatgctgacaactgcaaggtcctcgtcaacattgagcaacagagtcctgatattgctcaaggtgtgcacggccacctcacaaagaggccnnaggagattggtgctggtgaccaaggtcatatgttcggctatgccactgacgagactcccgagctcatgcccttgagccatgtccttgccacgaagctcggtgccaagctcaccgaggttcggaagaa

SEQ ID NO: 1749 - DNA, 311 bp, Glycine max
  unsure (1)..(311): unsure at all n locations
tcgcangcacncgtacgtaagctcggaattcggctcgagacagagtcctgatattgctcaaggtgtgcacggccacctcacaaagaggcctgaggagattggtgctggtgaccaaggtcatatgttcggctatgccactgacgagactcccgagctcatgcccttgagccatgtccttccacgaagctcggtgccaagctcaccgaggttcggaagaacgggacatgcccttggctgagacctgatggcaagacccaagtcactgttgagtactacaatgacaagggtgccatggttccaatccgcgtcca

SEQ ID NO: 1750 - DNA, 308 bp, Glycine max
  unsure (1)..(308): unsure at all n locations
gcangcacgcgtacgtaagctcggaattcggctcgangttcttgcaactaaactcggtgctcgtctcaccgaggttcgcaagaacggaacctgcccatggttgaggcctgatgggaagacccaagtgactgttgagtattacaatgacaacggtgccatggttccagttcgtgtccacactgtgcttatctccacccaacatgatgagactgtgaccaacgacgaaattgcagtgacctcaaggagcatgtgatcaagccggtgatcccggagaagtaccttgatgagaagaccattttccacttgaa

SEQ ID NO: 1751 - DNA, 394 bp, Glycine max
  unsure (1)..(394): unsure at all n locations
aagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgagaagattgtgcgtgacacatgcaaggaacattggnttttgtctctgatgaatgttggncttgatgctgacaactgcaaggnccccctcaaanattggnncacaaaantccggaanattgc

SEQ ID NO: 1752 - DNA, 326 bp, Glycine max
  unsure (1)..(326): unsure at all n locations
cangcacgcgtacgtaagctcggaattcggctcgagggaccctaccaaggttgacagaagtggtgcctatatcgtgaggcaggctgcaaagagtgttgtggcaaatggccttgccagaaggtgcattgtccaagtttcctatgccattggtgtccctgagcccttgtcagtgtttgtggacacttatggaactgggaagattcctgacaaggagattcttcaaattgtgaaggagaatttcgacttcagacctggaatgatcaccattaacttggaccttaagaggggtggccataggttcctcaagacagctgcttatggacact

SEQ ID NO: 1753 - DNA, 536 bp, Glycine max
  unsure (1)..(536): unsure at all n locations
gnnggngngtgnnttcntnnnnntntacnntttggcntgccgtaccggtccggaattcccgggtcgacccacgcgtccggcaagccccactcaaccaccacacctcttctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacgagaagatagtgcgtgacacctgcaggaacatcggcttcgtctcaaatgatgtgggactggatgccgacaactgcaaggtcttgtcaacattgacagcagaccctgatattggtcaagggtggtcacgggcaccttaccaaaaaaanctggaagaaattggggcttggnga

SEQ ID NO: 1754 - DNA, 286 bp, Glycine max
  unsure (1)..(286): unsure at all n locations
cacgcgtacgtaagctcggaattcggctcgagaccaaggttgataggagtggtgcttacattgtgagacaggctgctaagagcattgtggcaagtggactagccagaaggtgcattgtgcaagtgtcttatgccattggtgtgcccgagcctttgtctgtctttgttgacacctatggcaccgggaagatccatgataaggagattctcaacattgtgaaggagaactttgatttcaggcccggtatgatctccatcaaccttgntctcaagaggggtgggaataa

SEQ ID NO: 1755 - DNA, 276 bp, Glycine max
tagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgagaagattgtgcgtgacacatgcaggaacattggttttgtctctgatga

SEQ ID NO: 1756 - DNA, 300 bp, Glycine max
gtcgcatgcacgcgtacgtaagctcggaattcggctcgagggccaacgtagactatgagaagattgtccgtgacacatgccgcgaaattggattcatctctgatgatgttggtcttgatgctgacaaatgcaaggtgttggtcaacattgagcagcagagccctgatatcgcccagggtgtgcacggtcacttcaccaagcgcccagaggaggttggtgctggtgaccagggtcacatgtttgggctatgccatgatgaaacccctgagtacatgcccctcagccatgtccttgcaacca

SEQ ID NO: 1757 - DNA, 304 bp, Glycine max
  unsure (1)..(304): unsure at all n locations
nngtcgcangcacgcgtacgtaagctcggaattcggctcgagccctgatatcgcccagggtgtgcacggtcacttcaccaagcgcccagaggaggttggtgctggtgaccagggtcacatgtttggctatgccactgatgaaacccctgagtacatgcccctcagccatgtccttgcaaccaaactcggtgctcgcctcaccgaggttaggaaaaatggtacctgtgcttggctgaggccagatggcaagacacaagtaactgttgagtactacaatgacaatggtgccatggttccagttcgt

SEQ ID NO: 1758 - DNA, 309 bp, Glycine max
  unsure (1)..(309): unsure at all n locations
ngtcgcangcacgcgtacgtaagctcggaattcggctcgagctgcaaagagcattgttgcaaatggacttgctaggagggcaattgngcaagtttcctatgccattggtgtgcctgagcccttgtctgtgtttgttgacacttatgggcactgggaagatccctgacaaggaaatcctcagcattgtgaaggagagttttgacttcaggcctggcatgatctccatcaaccttgatctcaagaggggtggaaatggcaggttcttgaagactgctgcatatggacactttggcagagatgaccctgact

SEQ ID NO: 1759 - DNA, 320 bp, Glycine max
  unsure (1)..(320): unsure at all n locations
ncacgtcgangcacgcgtacgtaagctcggaattcggctcgaggagaagaccatcttccaccttaacccttctggccgttttgtcattggtggccctcatggtgatgctggtctcactggaagaaagatcatcattgatacctatggtgggtggggtgctcatggtggaggtgccttttcagggaaggaccctaccaaggttgacagaagtggtgcctatatcgtgaggcaggctgcaaagagtgttgtggcaaatggccttgccagaaggtgcatgtccaagtttcctatgccattggtgtccctgagccctgtcagtg

SEQ ID NO: 1760 - DNA, 295 bp, Glycine max
  unsure (1)..(295): unsure at all n locations
gtcgcangcacgcgtacgtaagctcggaattcggctcgaggcgtgacacatgcaggaacattggttttgtctctgatgatgttggtcttgatgctgacaactgcaaggtcctcgtcaacattgagcaacagagtcctgatattgctcaaggtgtgcacggccacctcacaaagaggcctgaggagattggtgctggtgaccaaggtcatatgttcggctatgccactgacgagactcccgagctcatgcccttgagccatgtccttgccacgaagctcggtgccaagctcaccgn

SEQ ID NO: 1761 - DNA, 297 bp, Glycine max
  unsure (1)..(297): unsure at all n locations
ngtcntangcacgcgtacgtaagctcggaattcggctcgagggtcaacattgagcaacagagcccggatatcgcccagggtgtgcacggccacttcaccaagcgcccagaggaggttggtgctggtgaccagggtcacatgtttgggtatgccaccgatgaaacccccgagtacatgcccctcagccatgtccttgcaaccaaacttggtgctcgcctcacagaggttaggaagaatggcacctgtgcttggttgaggccagatggtaagacacaagtaaccgtcgagtactacaat

SEQ ID NO: 1762 - DNA, 297 bp, Glycine max
  unsure (1)..(297): unsure at all n locations
tcgcatncacgcgtacgtaagctcggaattcggctcgagcatcattgatacctatggtggctggggtgctcatggtggaggtgccttttcagggaaggaccctaccaaggttgacagaagtggtgcctatattgtaaggcaggctgcaaagagtgtcgtggcaaatggccttgctagaaggtgcattgtgcaagtttcctatgccattggtgtccctgagcccttgtcagtgtttgtggacacttatggaactgggaagattcctgacaaggagattctgcaaattgtgaaggagaa

SEQ ID NO: 1763 - DNA, 303 bp, Glycine max
  unsure (1)..(303): unsure at all n locations
angangacgtcgctgcacgcgtacgtaagctcggaattcggctcgagggaagaacgggacatgcccttggctgagacctgatggcaagacccaagtcactgttgagtactacaatgacaagggtgccatggttccaatccgcgtccacactgtgctcatctccacacagcatgatgagnctgtcacaaatgatgagattgcagctgatcttaaagaacacgtgattaagcctgtgattcctgagaagtaccttgatgagaagaccattttccatttgaacccttctggcaggtttgtcattgg

SEQ ID NO: 1764 - DNA, 492 bp, Glycine max
  unsure (1)..(492): unsure at all n locations
gggnaantctacgcgnncagttctggtcagagccattcccgggnanaacccacgcgnccntacggctgcgagaaagacgacagaagggggcaacgctttgattttgagggcaaggcaaagccccactcaaaccaacacacctctcctccgttcacgctaccctttctgctcttcttctacctttcaagttttaaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacgagaagatagtgcgtgacacctgcaggaacatcggcttcgtctcaaatgatgtgggactggatgccgacaactgcaaaggtcctcgtca

SEQ ID NO: 1765 - DNA, 295 bp, Glycine max
  unsure (1)..(295): unsure at all n locations
acgtcgcangcacgcgtacgtaagctcggaattcggctcgaggtgccttttcagggaaggaccctaccaaggttgacagaagtggtgcctatatcgtgaggcaggctgcaaagagtgttgtggcaaatggccttgccagaaggtgcattgtccaagtttcctatgccattggtgtccctgagcccttgtcagtgtttgtggacacttatggaactgggaagattcctgacaaggagattcttcaaattgtgaaggagaatttcgacttcagacctggaatgatcaccattaactt

SEQ ID NO: 1766 - DNA, 290 bp, Glycine max
  unsure (1)..(290): unsure at all n locations
agtcgcangcacgcgtacgtaagctcggaattcggctcgagaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgagaagattgtgcgtgacacatgcaggaacattggttttgtctctgatgatgttantcttgatgctgacaactgcaaggtcctcgtcaacattgagcaacagagt

SEQ ID NO: 1767 - DNA, 300 bp, Glycine max
  unsure (1)..(300): unsure at all n locations
nagtcnncngaacgcgtnngtaagctcggtanttcggctcgangtgctcatggtggangngccttttcagggaaggaccctaccaaggttgacagaagtggtgcctatatcgtgaggcaggctgcaaagagtgttgtggcaaatggccttgccagaaggtgcattgtccaagtttcctatgccattggtgtccctgagcccttgtcagtgtttgtggacacttatggaactgggaagattcctgacaaggagattcttcaaattgtgaaggagaatttcgacttcagacctggaatgatc

SEQ ID NO: 1768 - DNA, 327 bp, Glycine max
  unsure (1)..(327): unsure at all n locations
gcagtgtacgtnagctcggaattcggctcgagcattggtgtgcctgagcccttgtctgtgtttgttgacacttatggcactgggaagatccctgacaaggaaatcctcagcattgtgaaggagagttttgacttcaggcctggcatgatctccatcaaccttgatctcaagaggggtggaaatggcaggttcttgaagactgcngcatatggacactttggcagagatgaccctgacttcacatgggaagtggtgaagccactcaagggggaaaaggtactgcttaactaaaaggggttccaacactcttggccaanggattttgcc

SEQ ID NO: 1769 - DNA, 322 bp, Glycine max
  unsure (1)..(322): unsure at all n locations
gcgtacgnaagctcggaattcggctcgagaatggacttgctaggagggcaattgtgcagtttcctatgccattggtgtgcctgagcccttgtctgtgtttgttgacacttatggcactgggaagatccctgacaaggaaatcctcagcattgtgaaggagagttttgacttcaggcctggcatgatctccatnaaccttgatctcaagaggggtggaaatggcaggttcttgaagactgctgcatatggacactttggcagagatgaccctgacttcacatgggaagtggtgaagccatcaagggggagaagacctgcttaa

SEQ ID NO: 1770 - DNA, 289 bp, Glycine max
  unsure (1)..(289): unsure at all n locations
gnncgnncgnaagctcggaattcggctcgagngccaagctcaccgaggttcggaagaacgggacatgcccttggctgagacctgatggcaagacccaagtcactgttgagtactacaatgacaagggtgccatggttccaatccgcgtccacactgtgctcatctccacacagcatgangagnctgtcacaaatgatgagattgcagctgatcttaaagaacacgnnattaagcctgtnatnccnganaagtnccttnatgagaagaccattttccatttgaacccttc

SEQ ID NO: 1771 - DNA, 297 bp, Glycine max
  unsure (1)..(297): unsure at all n locations
nnngcntnangtagcgnacgtaagctcggaattcggctcgagggaagaacgggacatgcccttggctgagacctgatggcaagacccaagtcactgttgagtactacaatgacaagggtgccatggttccaatccgcgtccacactgtgctcatctccacacagcatgatgagactgtcacaaatgatgagattgcagctgatcttaaagaacacgtgattaagcctgtgattcctgagaagtaccttgatgagaagaccattttccatttgaacccttctggcaggtttgtcattg

SEQ ID NO: 1772 - DNA, 260 bp, Glycine max
  unsure (1)..(260): unsure at all n locations
catgcaccaagaccaacatggtcatggtctttggagagatcnntaccaaggccaacgtagactatgagaagattgtccgtgacacatgccgcgaaattggattcatctctgatgatgttggtcttgatgctgacaatgcaaggtgttggtcaacattgagcagcagagccctgatatcgcccagggtgtgcacggtcacttcaccaagcgcccagaggaggttggtgctggtgaccagggtcacatgtttggctatgcca

SEQ ID NO: 1773 - DNA, 338 bp, Glycine max
  unsure (1)..(338): unsure at all n locations
ccnncccccacccncntacnaaagctcggaattcggctcgaggttcggctatgccactgacgagactcccgagctcatgcncttgagccatgtccttgccacgaagctncggtgccaagctcaccgaggttcggaanaacgggacatgcccttggctgagacctgatggcaagacccaagtcactgttgagtactacaatgacaagggtgccatggttccaatccgcgtccacactgtgctcatctccacacagcatgatgagactgtcacaaatgatgagattgcagtgatcttaaagaacacgtgattaagcctgtgattnctgagaagtaccttg

SEQ ID NO: 1774 - DNA, 294 bp, Glycine max
  unsure (1)..(294): unsure at all n locations
tngnangcacgcgtacgnaagctcggaattcggctcgagaactttcctattcacatctgaatcagtgaacgaggggcaccctgacaagctcctgtgaccagatctccgatgctgtgctcgatgcatgcttggagcaggaccctgacagcaaggttgcctgtgaaacctgcaccaagaccaacatggtgatggttnccggagagatcacaaccaaggccaacgtggactatgagaagattgtgcgtgacacatgcaggaacattggttttgtctctgatgatgttggtcttgatg

SEQ ID NO: 1775 - DNA, 317 bp, Glycine max
  unsure (1)..(317): unsure at all n locations
gtcgcatgcacncgtacgtaagctcgggaattcggctcgagtgtaaacgaaggtcaccccgacaagctgtgcgaccagatctctgatgcagtgctcgatgngtgcnttgaacaggaccctgacagcaaggttgcntgtgagacatgcaccaagaccaacatggtcatggtctttggagagatcacaaccaaggccaacgtagactatgagaagattgtccgtgacacatgccgcgaaattgggattcatctctggtggtgttggtcttgatnctgacaatgcaaggtgntggtcaaacattgagcagcagagccctg

SEQ ID NO: 1776 - DNA, 309 bp, Glycine max
  unsure (1)..(309): unsure at all n locations
gtcgcangcacgcgtacgtaagctcggaattcggctcgaggaccattttccatttgaacccttctggcaggtttgtcagcggagggccgcatggcgatgctggtctcaccggccgcaagatcatcatcgacacctatggaggatggggtgcacatggtggtggtgccttctctgggaaggatcctaccaaggttgataggagtggtgcctacattgtgaggcaagctgcaaagagcattgttgcaaatggacttgctaggaggcaattgtgcaagtttcctatgccattggtgtgcctgagcccttgtc

SEQ ID NO: 1777 - DNA, 329 bp, Glycine max
  unsure (1)..(329): unsure at all n locations
gtcgcatgcacgcgtacgtaagctcggaattcggctcgaggcagggacccagacagcaaagttgcctgcgaaacatgcaccaaaaccaacttggtcatggtcttncggagaaatcacgaccaaggccaacgttgactacgagaagatagtgcgtgacacctgcaggaacatcggcttcgtctcaaatgatgtgggactggatgccgacaactgcaaggtcctcgtcaacattgagcagcagagccctgatattgctcagggtgtacacggccaccttaccaaaaaacctgaagaaattggtgctggtgaccagggtcacatgtttggct

SEQ ID NO: 1778 - DNA, 518 bp, Glycine max
  unsure (1)..(518): unsure at all n locations
gaggnnnnnagggntnntnntatgaancnanggaacttttnngcntgcccgtaccggtccggattcccgggtcgacccacgcgtccgtacggctgcggaagacgacagaagggggcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacgagaagatagtgcgtgacacctgcaggaacatcggcttcgtctcaaatgatgtgggactggatgcccgacaactgcaaggtcctcgtnacattgac

SEQ ID NO: 1779 - DNA, 293 bp, Glycine max
  unsure (1)..(293): unsure at all n locations
gtcgcangcacgcgtacgtaagctcggaattcngctcgagntgagcaatgaccaaattgctgctgaccttaaagagcatgttattaagcctgtcattcctgagaagtacctggatgagaagaccatcttccaccttaacccttctggccgttttgtcattggtggccctcatggtgatgctggtctcactggaagaaagatcatcattgatacctatggtgggtggggtgctcatggtggaggtgccttttcagggaaggaccctaccaaggttgacagaagtggtgcctata

SEQ ID NO: 1780 - DNA, 269 bp, Glycine max
  unsure (1)..(269): unsure at all n locations
cgagggacaccctgataagctctgcgaccaaatctccgatgctgtcctcgacgcttgcctcgaacaggacccagacagcaaggttgcctgcgaaacatgcaccaagaccaacttggtcatggtcttcggagagatcaccaccaaggccaacgttgcatacgagaagatcgtgcgtgacacctgcaggagcatcggcttcatctcanacgatgtgggacttgatgctgacaactgcaaggtccttgtnaacattgagcagcngagccctg

SEQ ID NO: 1781 - DNA, 287 bp, Glycine max
tcgcatgcacgcgtacgtaagctcggaattcggctcgaggtggggtgctcatggtggaggtgccttttcagggaaggaccctaccaaggttgacagaagtggtgcctatatcgtgaggcaggctgcaaagagtgttgtggcaaatggccttgccagaaggtgcattgtccaagtttcctatgccattggtgtccctgagcccttgtcagtgtttgtggacacttatggaactgggaagattcctgacaaggagattcttcaaattgtgaaggagaatttcgacttca

SEQ ID NO: 1782 - DNA, 301 bp, Glycine max
  unsure (1)..(301): unsure at all n locations
cgcngcacgcgtacgtnagctcggaattcggctcgaggcacggccacctcacaaagaggcctgaggagattggtgctggtgaccaaggtcatatgttcggctatgccactgacgagactcccgagctcatgcccttgagccatgtccttgccacgaagctcggtgccaagctcaccgnggttcggaanaacgggacatgnccttggctganacctgatggcaagacncaagtcactgttgagtactacaatgacaagggtgccatggttccaatccgcgtccacactgtgctcatctccac

SEQ ID NO: 1783 - DNA, 305 bp, Glycine max
  unsure (1)..(305): unsure at all n locations
nagtcgcangcacgcgtacgtaagctcggaattcggctcgagccagaattcatgccattgagtcatgttcttgcaaccaagctcggtgctcgtctcaccgaggttcgcaagaacggaacctgcccatggctgaggcctgatgggaagacccaagtgactgtggagtattacaatgataatggtgccagggttccagttcgtgtncacaccgtgctaatctccacccagcatgatgagactgtcaccaacgacgaaattgcggctgacctcaaggagcatgtgatcaagcctgtgatcccggagaa

SEQ ID NO: 1784 - DNA, 287 bp, Glycine max
  unsure (1)..(287): unsure at all n locations
gtcgctgcacgcgtacgtnagctcggaattcggctcgagtgatgatgttggtcttgatgctgacaaatgcaaggtgttggtcaacattgagcagcagagccctgatatcgcccagggtgtgcacggtcacttcaccaagcgcccagaggaggttggtgctggtgaccagggtcacatgtttggctatgccactgatgaaacccctgagtacatgcccctcagccatgtccttgcaaccaaactcggtgctcgcctcaccgaggttaggaaaaatggtacctgtgctt

SEQ ID NO: 1785 - DNA, 310 bp, Glycine max
  unsure (1)..(310): unsure at all n locations
nancacgtcgcangcacgcgtacgtaagctcgggaattcggctcgagagggtcacatgtttggctatgccactgatgaaacccctgagtacatgcccctcagccatgtccttgcaaccaaactcggtgctcgcctcaccgaggttaggaaaaatggtacctgtgcttggctgaggccagatggcaagacacaagtaactgttgagtactacaatgacaatggtgccatggttccagttcgtgtccacactgtcctaatttccacccaacatgatgagnctgtgagcaatnaccaaattgctgctgacctt

SEQ ID NO: 1786 - DNA, 287 bp, Glycine max
  unsure (1)..(287): unsure at all n locations
gtcgcangcacgcgtacgtaagctcggaattcggctcgagntcacaaccaaggccaacgtagactatgaaaagattgtccgcgacacatgccgcgaaattggattcatctctgatgatgttggtcttgatgctgacaaatgcaaggtgttggtcaacattgagcaacagagcccggatatcgcccagggtgtgcacggccacttcaccaagcgcccagaggaggttggtgctggtgaccagggtcacatgtttgggtatgccaccgatgaaacccccgagtacatgc

SEQ ID NO: 1787 - DNA, 295 bp, Glycine max
gtcgcatgcacgcgtacgtaagctcggaattcggctcgaggtcttgatgctgacaactgcaaggtcctcgtcaacattgagcaacagagtcctgatattgctcaaggtgtgcacggccacctcacaaagaggcctgaggagattggtgctggtgaccaaggtcatatgttcggctatgccactgacgagactcccgagctcatgcccttgagccatgtccttgccacgaagctcggtgccaagctcaccgaggttcggaagaacgggacatgcccttggctgagacctgatggca

SEQ ID NO: 1788 - DNA, 321 bp, Glycine max
  unsure (1)..(321): unsure at all n locations
tcgcacgcacgcgtacgtaagctcggaattcggctcgagnagatggcagagacattcctatttacctcagantcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacgagaagatagtgcgtgacacctgcaggaacatcggcttcgtctcaaatgangtgggactggatgccgacaactgcaagtct

SEQ ID NO: 1789 - DNA, 270 bp, Glycine max
tagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgagaagattgtgcgtgacacatgcaggaacattggttttgtctc

SEQ ID NO: 1790 - DNA, 333 bp, Glycine max
  unsure (1)..(333): unsure at all n locations
tngatanacgcgtacgtnagctcggaattcggctcgagggaggttggtgctggtgaccagggtcacatgtttgggctatgccactgatgaaacccctgagtacatgcccctcagccatgtcttgcaaccaaactcggtgctcncctcaccgaggttaggaaaaatggtacctgtgcttggctgaggccagatggcaagacacaagtaactgttgagtactacaatgacaatggtgccatggttccagttcgtgtccacatgtcctaatttccacccaacatgatgagcctgtgagcaatgaccaaattgctgctgaccttaaagagcatgtta

SEQ ID NO: 1791 - DNA, 267 bp, Glycine max
  unsure (1)..(267): unsure at all n locations
caatggtgccatggttccagttcgtgtccacactgtcctaatttccacccaacatgatganacctgtgagcaatgaccaaattgctgctgaccttaaagagcatgttatcaagcctgtcattcctgagaagtacctggatgagaagaccatcttccaccttaacccttctggccgttttgtcattggtggccctcatggtgatgctggtctcactggaagaaagatcatcattgatacctatggtgggtggggtgctcatggtggag

SEQ ID NO: 1792 - DNA, 314 bp, Glycine max
  unsure (1)..(314): unsure at all n locations
ccanaatcgcatgcacgcgtacgtaagctcggaattcngctcgagctcgagccgctcgagccggaatcagtgaacgaggggcaccctgacaagctctgtgaccagatcctccgatgctgtgctcgatgcatgcttggagcaggaccctgacagcaaggttgcctgtgaaacctgcaccaagaccaacatggtgatggttttcggagagatcacaaccaaggccaacgtggactatgagaagattgtgcgtgacacatgcaggaacattggttttgtctctgatgatgttngtcttgatgctgacaactgcaagt

SEQ ID NO: 1793 - DNA, 512 bp, Glycine max
  unsure (1)..(512): unsure at all n locations
gnnnnnaattctacgccgnnctctaacgcgnnaacanaattcccggaaacgacccacgngnccnntgcgagaagacgacagaagggggcaacgcttnagcagacttnacaacancacaaagcnggttactgtctgttcaagctaacatctccctctctctttccttaantgcctccttnccaagaaagttaaaatggcccaagaaactttcctattcacatctgaatcaagttaacgaaggggcacccccgacaagctctgtgaccaagatctccgatgctgtgctcgatgcatgcttggagcaagaccctgacagcaangttgcctgtgaaacctgcaccaagaccaacatggtgatggttttcggagagattacaaccaangccaacgtggactatgagaagattgtgcgttacacatgcangaacattggttttgtctctgaagatgttggtcctgaagctgacaactgcaangtcctcgtcaacaattaacaacaanaattctgatat

SEQ ID NO: 1794 - DNA, 294 bp, Glycine max
  unsure (1)..(294): unsure at all n locations
nnngntctangcacgcgtacgtaagctcggaattcggctcgaggaccatcttccaccttaacccttctggccgttttgtcattggtggccctcatggtgatgctggtctcactggaagaaagatcatcattgatacctatggtggctggggtgctcatggtggaggtgccttttcagggaaggaccctaccaaggttgacagaagtggtgcctatattgtaaggcaggctgcaaagagtgtcgtggcaaatggccttgctagaaggtgcattgtgcaagtttcctatgccattg

SEQ ID NO: 1795 - DNA, 301 bp, Glycine max
  unsure (1)..(301): unsure at all n locations
cgannacgtcgcangcacgcgtacgtaagctcggaattcggctcgagggacgagaccccagaattgatgccattgagtcatgttcttgcaactaaactcggtgctcgtctcaccgaggttcgcaagaacggaacctgcccatggttgaggcctgatgggaagacccaagtgactgttgagtattacaatgacaacggtgccatggttccagttcgtgtccacactgtgcttatctccacccaacatgatgagactgtgaccaacgacgaaattgcagctgacctcaaggagcatgtgatca

SEQ ID NO: 1796 - DNA, 277 bp, Glycine max
gcatgcacgcgtacgtaagctcggaattcggctcgagagtggtgcctacattgtgaggcaagctgcaaagagcattgttgcaaatggacttgctaggagggcaattgtgcaagtttcctatgccattggtgtgcctgagcccttgtctgtgtttgttgacacttatggcactgggaagatccctgacaaggaaatcctcagcattgtgaaggagagttttgacttcaggcctggcatgatctccatcaaccttgatctcaagaggggtggaaatggc

SEQ ID NO: 1797 - DNA, 297 bp, Glycine max
  unsure (1)..(297): unsure at all n locations
gcangcacgcnnacgtnagctcggaattcggctcgagaccctaccaaggttgacagaagtggngcctatatcgtgaggcaggctgcaaagagtgttgtggcanatggccttgccagaaggtgcattgtccaagtttcctatgccattggtgtccctgagcccttgtcagtgtttgtggacacttatggaactgggaagattcctgncaaggagattcttcaaattgtgaaggagaatttcgacttnagacctggaatgatcaccattaacttggaccttaagaggggtggccatagg

SEQ ID NO: 1798 - DNA, 264 bp, Glycine max
  unsure (1)..(264): unsure at all n locations
agagcccggatatcgcccagggtgtgcacggccacttcaccaagcgcccagaggaggttggtgctggtgaccagggtcacatgtttgggtatgncaccgatgaaacccccgagtacatgcccctcagccatgtccttgcaaccaaacttggtgctcgcctcacagaggttaggaagaatggcacctgtgcttggttgaggccagatggtaagacacaagtaaccgtcgagtactacaatgacaatggtgccatggttccattcg

SEQ ID NO: 1799 - DNA, 311 bp, Glycine max
  unsure (1)..(311): unsure at all n locations
nagtcgcangcacgcgtacgtaagctcggaattcggctcgagccagaattcatgccattgagtcatgttcttgcaaccaagctcggtgctcgtctcaccgaggttcgcaagaacggaacctgcccatggctgaggcctgatgggaagacccaagtgactgtggagtattacaatgataatggtgccagggttccagttcgtgtncacaccgtgctaatctccacccagcatgatgagactgtcaccaacgacgaaattgcggctgacctcaaggagcatgtgatnaagcctgtgatcccggngaagtnctt

SEQ ID NO: 1800 - DNA, 508 bp, Glycine max
  unsure (1)..(508): unsure at all n locations
ttttgtntnccgaggccccnacnancntcntggcctcgngnccacgcgtangtaaantcggaattcggctcgagatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacganaagatagtgcgtgacanctgcaagaacatcggcttcntctcaaatgatgtgggactggatgccgacaactgcaaggtcctccgtcaacantgaacaacaagaaccctgatattgcncaagggtttnaaccggc

SEQ ID NO: 1801 - DNA, 292 bp, Glycine max
  unsure (1)..(292): unsure at all n locations
gtcgcangcacgcgtacgtaagctcggaattcggctcgagccctaccaaggttgacagaagtggtgcctatatcgtgaggcaggctgcaaagagtgttgtggcaaatggccttgccagaaggtgcattgtccaagtttcctatgccattggtgtccctgagcccttgtcagtgtttgtggacacttatggaactgggaagattcctgacaaggagattcttcaaattgtgaaggagaatttcgacttcagacctggaatgatcaccattaacttggaccttaagaggggtgg

SEQ ID NO: 1802 - DNA, 306 bp, Glycine max
  unsure (1)..(306): unsure at all n locations
cgtcgcangcacgcgtacgtaagctcggaattcggctcgagctcgagccgcgcccagaggaggttggtgctggtgaccagggtcacatgtttggctatgccactgatgaaacccctgagtacatgcccctcagccatgtccttgcaaccaaactcggtgctcgcctcaccgaggttaggaaaaatggtacctgtgcttggctgaggccagatggcaagacacaagtaactgttgagtactacaatgacaatggtgccatggttccagttcgtgtccacactgtcctaatttccacccaacatgatc

SEQ ID NO: 1803 - DNA, 309 bp, Glycine max
  unsure (1)..(309): unsure at all n locations
acgtcgcatgcacgcgtacgtaagctcggaattcggctcgagctccgatgctgtgctcgatgcatgcttggagcaggaccctgacagcaaggttgcttgtgaaacctggcaccaagaccaacatggtgatggttttcggagagatcacaaccaaggccaacgtggactatgagaagattgtgcgtgacacatgcaggaacattggttttanctctgatgatgttggtcttgatgctgacaactgcaaggtcctcgtcaacattgagcaacagagtcctgatattgctcaaggtgtgcacggccacctca

SEQ ID NO: 1804 - DNA, 437 bp, Glycine max
  unsure (1)..(437): unsure at all n locations
gagaagacgacagaagggggcancgcttgatttnaggccaggcangccccactcanccaccacacctctcctcnttcacgctacccctttctgctcttcttctanctttcaagttttaaaagtataaagatggcagaganattcntatttacctcagagtcggtgaacgagggacaccctgacaagctctgcgaccaaatctccgatgctgtcctcgacgcttgcctcnagcagganccanacagcaaaattgcctgcnaaacatgcaccaaaaccaacttggtcatggtcttcggaganatcacgaccaaggccaacgttgactacgagaagatagtgcgtgacacctgcaggaacatcggcttcgtctcaaaatgatgtgggactggatcccgacaactgcaangtcctcgtcaacatttgaacancanagccct

SEQ ID NO: 1805 - DNA, 299 bp, Glycine max
  unsure (1)..(299): unsure at all n locations
gtcgcgnnnacgcgtacgtaagctcggaattcggctcgagaacagagtcctgatattgctcaaggtgtgcacggccaccttcacaaagaggcctgaggagattggtgctggtgaccaaggtcatatgttcggctatgccactgacgagactcccgagctcatgcccttgagccatgtccttgccacgaagctcggtgccaagctcaccgaggttcggaagaacgggacatgcccttggctgagacctgatggcaagacccaagtcactgttgagtactacaatgacaagggtgccatgg

SEQ ID NO: 1806 - DNA, 296 bp, Glycine max
cgtcgcatgcacgcgtacgtaagctcggaattcggctcgagtcacgaccaaggccaacgttgactacgagaagatagtgcgtgacacctgcaggaacatcggcttcgtctcaaatgatgtgggactggatgccgacaactgcaaggtcctcgtcaacattgagcagcagagccctgatattgctcagggtgtacacggccaccttaccaaaaaacctgaagaaattggtgctggtgaccagggtcacatgtttggctatgccactgatgaaacccctgaattgatgccattgagcc

SEQ ID NO: 1807 - DNA, 308 bp, Glycine max
  unsure (1)..(308): unsure at all n locations
ntcgcatgcacgcgtacgtaagctcggaattcggctcgagctcgagccgcattcctgagaagtaccttgatgagaagaccatcttccaccttaacccttcangccgttttgtcattggtggccctcatggtgatgctggtctcactggaagaaagatcatcattgatacctatggtggctggggtgctcatggtggaggtgccttttcagggaaggaccctaccaaggttgacagaagtggtgcctatattgtaaggcaggctgcaaagagtgtcgtggcaaatggccttgctagaaggtgcatgtgc

SEQ ID NO: 1808 - DNA, 261 bp, Glycine max
  unsure (1)..(261): unsure at all n locations
caggctgctaagagcattgtggcaagtggacttgccagaaggtgcattgtgcaagtgtcttatgccattggtgtgcctgagcctttgtctgtgtttgttgacacctatggcactgggaagatccatgataaggagattctcaacattgtgaaggaaaactttgatttcaggcctggtatgatctccatcaaccttgatctcaagaggggtggaaataacnggttttggannactgccnccnatggacanttggaangnacc

SEQ ID NO: 1809 - DNA, 275 bp, Glycine max
  unsure (1)..(275): unsure at all n locations
cgtcgcangcacgcgtacgtaagctcggaattcggctcgngctgagcccttgtctgtgtttgttgacacttatggcactgggaagatccctgacaaggaaatcctcagcattgtgaaggagagttttgacttcaggcctggcatgatctccatcaaccttgatctcaagaggggtggaaatggcaggttcttgaagactgctgcatatggacactttggcagagatgaccctgacttcacatgggaagtggtgaagccactcaagggggagaagg

SEQ ID NO: 1810 - DNA, 270 bp, Glycine max
  unsure (1)..(270): unsure at all n locations
nantcgnangctcngaattcggctcgagggtgatggttttcggagnnntcanaaccaaggccaacgtggactatgagaagattgtgcgtgacacatgcaggaacattggttttgtctctgatgatgttggtcttgatgctgacaactgcaaggtcctcgtcaacattgagcaacagagtcctgatattgctcaaggtgtgcacggccacctcacaaagaggcctgaggagattggtgctggtgaccaaggtcatatgttcggctatgcca

SEQ ID NO: 1811 - DNA, 317 bp, Glycine max
  unsure (1)..(317): unsure at all n locations
tgcacgcgtacgtaagctcggaattcggctcgaggacacctatggaggatggggtgcacatggtggtggtgccttctctgggaaggatcctatcaaggttgataggagtggtgcctacattgtgaggcaagctgcaaagagcattgttnccaaatggacttgctaggagggcaattgtgcaagtttcctatgccattggtgtgcctgagcccttgtctgtgtttgttgacacttatggcactgggaagatccctgacaaggaaatcctcagcattgtgaaggagagttttgactcaggcctggatgatctcnatcac

SEQ ID NO: 1812 - DNA, 323 bp, Glycine max
  unsure (1)..(323): unsure at all n locations
acgtcncangcangcgtacgtaagctcggnattcggctcgaggcttgagaaatggcacaaganacctttctattcacatctgaatctgtaaacgagggtcaccccgacaagctgtgcgaaccagatctctgatgcagtgctcgatgcgtgccttgaacaggaccctgacagcaaggttgcctgtgagacatgcaccaagaccaacatggtcatggtctttggagngatcacanccaagggccnnacgtagnctatgagaagattgtccgtgacacctgccgcgaaattggattcatctctgatgtgttcggtcnngatgcgcc

SEQ ID NO: 1813 - DNA, 342 bp, Glycine max
  unsure (1)..(342): unsure at all n locations
gctgcaaagagtgttgtggcaaatggccttgccagaaggtgcattgtccaagtttcctatgccattggtgtccctgagcccttgtcagtgtttgtggacacttatggaactgggaagattcctgacaaggagattcttcaaattgtgaaggagaatttcgacttcagacctggaatgatcaccattaacttggaccttaagaggggtggccataggttcctcaagacagctgcttatggacactttggaagggatgacctgacttcacctgggaagttgtgaagccatcaagtctgagaagccncaacttagatgtgtgagttaaccatcccttcatggngc

SEQ ID NO: 1814 - DNA, 318 bp, Glycine max
  unsure (1)..(318): unsure at all n locations
agtcgcangcacgcgtacgtaagctcggaattcggctcgagacggctgcgagaagcgacagaaggggaagaaagatcatcattgatacctatggtggctggggtgctcatggtggaggtgccttttcagggaaggaccctaccaaggttgacagaagtggtgcctatattgtaaggcaggctgcaaagagtgtcgtggcaaatggccttgctagaaggtgcattgtgtcagtttcctatgccattggtgtccctgagcccttgtcagtgtttgtggacacttatggaactgggaagattcctgacaaggagattctgc

SEQ ID NO: 1815 - DNA, 280 bp, Glycine max
  unsure (1)..(280): unsure at all n locations
cgcntgcacgcgtacgtaagctcggaattcggctcgagcacctatggaggatggggtgcacatggtggtggtgccttctctgggaaggatcctaccaaggttgataggagtggtgcctacattgtgaggcaagctgcaaagagcattgttgcaaatggacttgctaggagggcaattgtgcaagtttcctatgccattggtgtgcctgagcccttgtctgtgtttgttgacacttatggcactgggaagatccctgacaaggaaatcctcagcattgtgn

SEQ ID NO: 1816 - DNA, 236 bp, Glycine max
gagcattgtggcaagtggacttgccagaaggtgcattgtgcaagtgtcttatgccattggtgtgcctgagcctttgtctgtgtttgttgacacctatggcactgggaagatccatgataaggagattctcaacattgtgaaggaaaactttgatttcaggcctggtatgatctccatcaaccttgatctcaagaggggtggaaataacaggtttttgaagactgctgcctatggac

SEQ ID NO: 1817 - DNA, 314 bp, Glycine max
  unsure (1)..(314): unsure at all n locations
acgtcgcangcacgcngacgtaagctcggaattcggctcgaggtgccntctctggganggatcctaccaaggttgatatgantggtgcctanattgtgaggcaagctgcaaagagcattgttgcaaatggacttgctaggagggcaattgtncaagtttcctatgccattggtgngcctgagcccttntctgtgtttgttgacacggatggcactgggaagatccctgacaangnaatcctcagcattgtgaaggagagttttgacttcaggcctggcntgatctccatcnaccttgagctcaagaggggtgnn

SEQ ID NO: 1818 - DNA, 267 bp, Glycine max
  unsure (1)..(267): unsure at all n locations
gtcgcangcacgcgtacgtnagctcggaattcggctcgagcaatgacgaaattgctgctgacctcaaagagcatgtgatcaagcctgtgatcccagagaagtaccttgatgagangaccattttccacttgaacccttcaggccgttttgtcattggtggccctcatggcgatgctggtctcaccggccgcaagatcattatcgatacttatggaggatggggtgctcatggtggtggtgctttctccgggaaggaccctaccaagg

SEQ ID NO: 1819 - DNA, 278 bp, Glycine max
  unsure (1)..(278): unsure at all n locations
gtcgcangcacgcntacgtaagctcggaattcggctcgagctctgggaaggatcctaccaaggttgataggagtggtgcctacattgtgaggcaagctgcaaagagcattgttgcaaatggacttgctaggagggcaattgtgcaagtttcctatgccattggtgtgcctgagcccttgtctgtgtttgttgacacttatggcactgggaagatccctgacaaggaaatcctcagcattgtgaaggagagttttgacttcaggcctggcatgatctcc

SEQ ID NO: 1820 - DNA, 281 bp, Glycine max
  unsure (1)..(281): unsure at all n locations
catcgtatgcncgcgtacgtaagctcggaattcggctcgagaattgtgcaagtttcctatgccattggtgtgcctgagcccttgtctgtgtttgttgacacttatggcactgggaagatccctgcacaaggaaatcctcagcattgtgaaggagagttttgacttcaggcctggcatgatctccatcaaccttgatctcaagaggggtggaaatggcaggttcttgaagactgctgcatatggacactttggcagagatgaccctgacttcacatgggaag

SEQ ID NO: 1821 - DNA, 255 bp, Glycine max
  unsure (1)..(255): unsure at all n locations
cttgccagaaggtgcattgtgcaagtgtcttatgccattggtgtncctgagcctttgtactgtgtttgttgacacctatggcactggaaagatccctgacaaggagntccttaacattgtgaaggagaactttgatttcaggcctggtatgatctccatcaaccttgatctcaagaggggnggaaataacaggtttttgaagactgctgcatatggacactttggaagagaggaccctggacttcacatgggaag

SEQ ID NO: 1822 - DNA, 300 bp, Glycine max
  unsure (1)..(300): unsure at all n locations
gtcgcatgcacgcgtacgtaagctcggaattcggctcganggagtggtgcctacattgtgangcaagctgcaaagagcattgttgcaaatggacttgctaggagggcaattgtgcaagtttcctatgccattggtgtgcctgagcccttgtctgtgtttgttgacacttatggcactgggaagatccctgacaaggaaatcctcagcattgtgaaggagagttttgacttcaggctggcatgatctccatcaacttgatctcaagaggggtgggaatggcaggttcttgagatgctgcaa

SEQ ID NO: 1823 - DNA, 283 bp, Glycine max
  unsure (1)..(283): unsure at all n locations
gtcgcangcacgcgtacgtaagctcggaattcggctcgaggtgcctacattgtgaggcaagctgcaaagagcattgttgcaaatggacttgctaggagggcaattgtgcaagtttcctatgccattggnctgcctgagcccttgtctgtgtttgttgacacttatggcactgggaagatccctgacaaggaaatcctcagcattgtgaaggagagttttgacttcaggcctggcatgatctcatcaaccttgatctcaagaggggtggaaatggcaggttctt

SEQ ID NO: 1824 - DNA, 306 bp, Glycine max
  unsure (1)..(306): unsure at all n locations
accgtgnanncacncgtacgtaagctcggaattcggctcgagnggcaggtttgtcattggagggccgcatggcgatgntggtctcaccggccgcaagatcatcatcgacacctatggaggatggggtgcacatggtggtggtgccttctctgggaaggatcctaccaaggntgataggagtggtgcctacattgtgaggcaagctgcaaagagcattgttgcaaatggacttgctaggagggcaattgtgcaagtttcctatggccattggtgtgcctgagcccttgtctgtgtttgtngacactt

SEQ ID NO: 1825 - DNA, 313 bp, Glycine max
  unsure (1)..(313): unsure at all n locations
gtcgcatgcacgcgtacgtaagctcggaattcggctcgagggaggttggtgctggtgaccagggtcacatgtttggctatgccactgatgaaacccctgagtacatgcccctcagccatgtccttgcaaccaaactcggtgctcgcctcaccgaggttaggaaaaatggtacctgtgcttggctgaggccagatggcaagacacaagtaactgttgagtactacaatgacaatggtgccatggttccagttcgtgtccacantgtcntaatttccacccancatgatcctnctgtgagcatgaccaaattggt

SEQ ID NO: 1826 - DNA, 357 bp, Glycine max
ccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaagttgcctgcgaaacatgcaccaaaaccaacttggtcatggtcttcggagaaatcacgaccaaggccaacgttgactacgagaagatagtgcgtgacacctgcaggaacatcggcttcgtctcaaatgatgtgggatggatgccgacaactgcaaggtcctcgtca

SEQ ID NO: 1827 - DNA, 320 bp, Glycine max
  unsure (1)..(320): unsure at all n locations
tgncgcatgcactcgtacgtaagctcggaattcggctcgaggcaaggtcctcgtcaacattgagcaacagagtcctgatattgctcaaggtgtgcacggccaccttcacaaagaggcctgaggagattggtgctggtgaccaaggtcatatgttcggctatgccactgacgagactcccgagctcatgcccttgagccatgtccttgccacgaagctcggtgccaagctcaccgaggttcggaagaacgggacatgcccttggctgagacctgatggcaagacccaagtcatgttgagtatacaatgacaagggtgccat

SEQ ID NO: 1828 - DNA, 282 bp, Glycine max
  unsure (1)..(282): unsure at all n locations
nngtcgcatgcacgcgtacgtaagctcggaattcggctcgagggtcctcgtcaacattgagcaacagagtcctgatattgctcaaggtgtgcacggccacctcacaaagaggcctgaggagattggtgctggtgaccaaggtcatatgttcggctatgccactgacgagactcccgagctcatgcccttgagccatgtccttgccacgaagctcggtgccaagctcaccgaggttcggaagaacgggacatgcccttggctgagacctgatggcaagaccca

SEQ ID NO: 1829 - DNA, 283 bp, Glycine max
cgtgacacatgccgcgaaattggattcatctctgatgatgttggtcttgatgctgacaaatgcaaggtgttggtcaacattgagcagcagagccctgatatcgcccagggtgtgcacggtcacttcaccaagcgcccagaggaggttggtgctggtgaccagggtcacatgtttggctatgccactgatgaaacccctgagtacatgcccctcagccatgtcttgcaaccaaactcggtgctcgctcaccgaggttaggaaaaatggtactgtgcttggctga

SEQ ID NO: 1830 - DNA, 290 bp, Glycine max
  unsure (1)..(290): unsure at all n locations
ncncangcacgcgtacgtaagctcggaattcggctcgagncgtgacacctgcaggaacatcggcttcgtctcaaatgatgtgggactggatgccgacaactgcaaggtcctcgtcaacattgagcagcagagccctgatattgctcagggtgtacacggccaccttaccaaaaaacctgaagaaattggtgctggtgaccagggtcacatgtttggctatgccactgatgaaacccctgaattgatgccattgagccatgttcttgcaacaaaactcggtgctcgtctca

SEQ ID NO: 1831 - DNA, 268 bp, Glycine max
  unsure (1)..(268): unsure at all n locations
gtcgcangcacgcgtacgtaagctcggaattcggctcgagcatgcttgncagcaggaccctgacagcaaggttgcctgtgaaacctgcaccaagaccaacatggtgatggttttcggagagatcacaaccaaggccaacgtggactatgagaagattgtgcgtgacacatgcaggaacattggttttgtctctgatgatgttggtcttgatgctgacaactgcaaggtcctcgtcaacattgagcaacagagtcctgatattgctcaa

SEQ ID NO: 1832 - DNA, 315 bp, Glycine max
  unsure (1)..(315): unsure at all n locations
cgcangcacgcgtacgtaagctcggaattcngctcganggagattggtgctggtgaccaaggtcatgggttcggctatgccactgacgagactcccgagctcatgcccttgagccatgtccttgccacgaagctcggtgccaagctcaccgaggttcggaagaacgggacatgcccttggctgagacctgatggcaagacccaagtcactgttgagtactacaatgacaagggtgccatggttccaatccgcgtccacactgtgctcatctncacacaacatacgaccngagtgtggncgcggattggnacatgg

SEQ ID NO: 1833 - DNA, 240 bp, Glycine max
agaaattggtgctggtgaccagggtcacatgtttggctatgccactgatgaaacccctgaattgatgccattgagccatgttcttgcaacaaaactcggtgctcgtctcaccgaggttcgcaagaacggtacctgcccttggctgaggcctgatgggaagacccaagtgaccgttgagtattacaatgacaatggtgccagggttcctattcgtgtacacaccgtgctaatctccaccca

SEQ ID NO: 1834 - DNA, 296 bp, Glycine max
  unsure (1)..(296): unsure at all n locations
antcgcatgcacgcgtacgtaagctcggaattcggctcgaggctcgatgcatgcttggagcaggaccctgacagcaaggttgcctgtgaaacctgncaccaagaccaacatggtgatggttttcggagagatcacaaccaaggccaacgtggactatgagaagattgtgcgtgacacatgcaggaacattggtccaagtctctgatgatgttggtcttgatgctgacaactgcaaggtcctcgtcaacattgagcaacagagtcctgatattgctcaaggtgtgcacggccacctc

SEQ ID NO: 1835 - DNA, 286 bp, Glycine max
gtcgcatgcacgcgtacgtaagctcggaattcggctcgaggcaagatcattatcgatacttatggaggatggggtgctcatggtggtggtgctttctccgggaaggaccctaccaaggttgataggagtggtgcttacattgtgagacaggctgctaagagcatgtggcaagtggacttgccagaaggtgcattgtgcaagtgtcttatgccattggtgtgcctgagcctttgtctgtgtttgttgacacctatggcactgggaagatccatgataaggagattct

SEQ ID NO: 1836 - DNA, 341 bp, Glycine max
  unsure (1)..(341): unsure at all n locations
nacangcacgcntacgtaagctcggaattcggctcgagctcaagtttttgaagtatagagatggcagagacattcctatttacctcagagtcagtgaacgagggacaccctgnccaagctctgtgaccaaatctctgatgctgtcctcgacgcttgcctcgaacaggacccagacagcaaggttgcctgcgaaacatgcaccaaaaccaacttggtcatggtcttcggagaaatcacgaccaaggccaatgttgactacgagaagatagtgcgtgacacctgcaggaacatcggctttgtctcaaacgatgtgggactggatgccgacaatgcaaggtcct

SEQ ID NO: 1837 - DNA, 313 bp, Glycine max
  unsure (1)..(313): unsure at all n locations
gtcnnangcacgntacgtaagctcggaattcggctcganctcgagccgaatcggctcgaggccgcatggcgatgctggtctcncncggccgcaagatcancatcgacacctatggagganggggtgcacatggtggtggtgccttctctgggaaggatcctaccaaggttgataggagtggtgcctacattgtgaggcaagctgcaaagagcattgttgcaaatggacttgctaggagggcaattgtgcaagtttcctatgccattggtgtgcctgagcccttgtctgtgtttgttgacacttatggcactgg

SEQ ID NO: 1838 - DNA, 276 bp, Glycine max
  unsure (1)..(276): unsure at all n locations
nangcacgcgtacgtaagctcggaattcggctcgaggacacctgcaggaacatcggcttcgtctcaaatgatgtgggactggatgccgacaactgcaaggtcctcgtcaacattgagcagcagagccctgatattgctcagggtgtacacggccaccttaccaaaaaacctgaagaaattggtgctggtgaccagggtcacatgtttggctatgccactgatgaaacccctgaattgatgccattgagccatgttcttgcaacaaaactcggtgct

SEQ ID NO: 1839 - DNA, 286 bp, Glycine max
  unsure (1)..(286): unsure at all n locations
angtcgcangcacgcgtacgtaagctcggaattcggctcgagntgcaccaaaaccaacttggtcatggtcttcggagaaatcacgaccaaggccaacgttgactacgagaagatagtgcgtgacacctgcaggaacatcggcttcgtctcaaatgatgtgggactggatgccgacaactgcaaggtcctcgtcaacattgagcagcagagccctgatattgctcagggtgtacacggccaccttaccaaaaaacctgaagaaattggtgctggtgaccagggtcac

SEQ ID NO: 1840 - DNA, 315 bp, Glycine max
  unsure (1)..(315): unsure at all n locations
gtcgctagcacgcgtacgtaagctcggaattcggctcgagntttcctatgccattggtgtccctgagcccttgncagtgtttgtggacacttatggaactgggaagattcctgacaaggagattcttcaaattgtgaaggagaatttcgacttcagacctggaatgatcaccattaacttggaccttaagaggggtggccataggttcctcaagacagctgcttatggacactttggaagggatgaccctgacttcacctgggaagttgtgaagccactcaagtctgagaagcctcaagcntaagattgttgtga

SEQ ID NO: 1841 - DNA, 408 bp, Glycine max
  unsure (1)..(408): unsure at all n locations
gagaagacgacagaagggggcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacgagaagatagtgcgttacacctgcaagaacatccgntttctctcnaatgatttggaactggatnccaaaaattgcaaggtc

SEQ ID NO: 1842 - DNA, 255 bp, Glycine max
ttgatacctatggtggctggggtgctcatggtggaggtgccttttcagggaaggaccctaccaaggttgacagaagtggtgcctatattgtaaggcaggctgcaaagagtgtcgtggcaaatggccttgctagaaggtgcattgtgcaagtttcctatgccattggtgtccctgagcccttgtcagtgtttgtggacacttatggaactgggaagattcctgacaaggagattctgcaattgtgaaggagattcc

SEQ ID NO: 1843 - DNA, 273 bp, Glycine max
tctcaagtttttgaagtatagagatggcagagacattcctatttacctcagagtcagtgaacgagggacaccctgacaagctctgtgaccaaatctctgatgctgtcctcgacgcttgcctcgaacaggacccagacagcaaggttgcctgcgaaacatgcaccaaaaccaacttggtcatggtcttcggagaaatcacgaccaaggccaatgttgactacgagaagatagtgcgtgacacctgcaggaacatcggctttgtctcaaacgatg

SEQ ID NO: 1844 - DNA, 272 bp, Glycine max
  unsure (1)..(272): unsure at all n locations
nacgcangcncgcgtacgtaagctcggaattcggctcgagagtggacttgccagaaggtgcattgtgcaagtgtcttatgccattggtgtgcctgagcctttgtctgtgtttgttgacacctatggcactgggaagatccatgataaggagattctcaacattgtgaaggaaaactttgatttcaggcctggtatgatctccatcaaccttgatctcaagaggggtggaaataacaggtttttgaagactgctgcctatggacactttggaa

SEQ ID NO: 1845 - DNA, 279 bp, Glycine max
  unsure (1)..(279): unsure at all n locations
gtcgcangcacgcgtacgtaagctcggaattcggctcgagcacgaagctcggtgccaagctcaccgaggttcggaagaacgggacatgcccttggctgagacctgatggcaagacccaagtcactgttgagtactacaatgacaagggtgccatggtncccaatccgcgtccacactgtgctcatctccacacagcatgatgagactgtcacaaatgatgagattgcagctgatcttaaagaacacgtgattaagcctgtgattcctgagaagtacctt

SEQ ID NO: 1846 - DNA, 269 bp, Glycine max
  unsure (1)..(269): unsure at all n locations
gtcgcatgcacgcgtacgtaagctcggaattcggctcgaggaccaacatggtgatggttttcggagagatcacaaccaaggccaacgtggactatgagaagattgtgcgtgacacatgcaggaacattggttttgtctctgatgatgttggtcttgntgctgacaactgcaaggtccctcgtcaacattgagcaacagagtcctgatattgctcaaggtgtgcacggccacctcacaaagacgcctgaggagattggtgctggtgacca

SEQ ID NO: 1847 - DNA, 439 bp, Glycine max
  unsure (1)..(439): unsure at all n locations
ccacgcgtccgtacngctgcgagaagacgacagaagggggcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacgagctctgcgaccaaatctccgatgctgtcctcgacgcttgcctcgagcaggacccagacagcaaagttgcctgcgaaacatgcaccaaaaccaacttggtcatggtcttcggagaaatcacgaccaangncaacgttgactacganaaaganantgggttanactngcagganntcggcttcgtctcaaatgatgtgggactggatgccgacaactgcaaggtcctcgtcaacat

SEQ ID NO: 1848 - DNA, 407 bp, Glycine max
  unsure (1)..(407): unsure at all n locations
tcgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacgagaagatagtgcgtgacacctgcaagaacatcgggttcgtcccaaatgatgtttggaactggggttccgacaactgggaaaggtcctcgttcaanattgagcaagcaaag

SEQ ID NO: 1849 - DNA, 282 bp, Glycine max
  unsure (1)..(282): unsure at all n locations
gtcgcaggcacgcgtacgtnagctcggaattcggctcgagnttcctatttacctcagagtcagtgaacgagggacaccctgacaagctctgtgaccaaatctctgatgctgtcctcgacgcttgcctcgaacaggacccagacagcaaggttgcctgcgaaacatgcaccaaaaccaacttggtcatggtcttcggagaaatcacgaccaaggccaatgttgactacgagaagatagtgcgtgacacctgcaggaacatcggctttgtctcaaacgatgtgg

SEQ ID NO: 1850 - DNA, 266 bp, Glycine max
  unsure (1)..(266): unsure at all n locations
agtngcangcacgcgtacgtaagctcggaattcggctcgagagcaatttatcaagcctgtcattcctgagaagtacctggatgagaagaccatcttccaccttaacccttctggccgttttgtcattggtggccctcatggtgatgctggtctcactggaagaaagatcatcattgatacctatggtgggtggggtgctcatggtggaggtgccttttcagggaaggaccctaccaaggttgacagaagtggtgcctatatcgtga

SEQ ID NO: 1851 - DNA, 272 bp, Glycine max
  unsure (1)..(272): unsure at all n locations
ggtgctcatggtggtggtgccttctccgggaaggatcccaccaaggttgataggagtggtgcttacattgtgagacaggctgctaagagcattgtggcaagtggactagccagaaggtgcattgtgcaagtgtcttatgccattggtgtgcccgagcctttgtctgtctttgttgacacctatggcaccgggaagatccatgataaggagattctcaacattgtgaaggagaatttgattncaggcccggtatgatctccatcaaccttgat

SEQ ID NO: 1852 - DNA, 305 bp, Glycine max
  unsure (1)..(305): unsure at all n locations
cnncatncgtaagtnantncnncattnggctcgagccaacttggtcatggtctncggatanatcntgnccaaggccancgttgnctacgagnagatagtgcgtgacacctgcaggaacatcggcttcgtctcanatgatgtgggactggatgccgacaactgcaaggtcctcgtcaacattgagcagcagagccctgatattgctcagggtgtacacggccaccttaccaaaaaacctgaagaaattggtgctggtgaccagggtcacatgtttggctatgccatgatganccctgaattgatgc

SEQ ID NO: 1853 - DNA, 340 bp, Glycine max
  unsure (1)..(340): unsure at all n locations
agtcgcangcacgcgtacgtaagctcggaattcggctcgagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgagaagattgtgcgtgacacatg

SEQ ID NO: 1854 - DNA, 329 bp, Glycine max
  unsure (1)..(329): unsure at all n locations
agtcgcangcacgcntacgtaagctcggaattcggctcgagctctctgttctcttctacctctcaagtntttgaagtatagagatggcagagacattcctatttacctcagagtcngtgaacgagggacaccctgacaagctctgtgaccaaatctctgatgctgtcctcgacgcttgcctcgaacaggacccagacagcaaggttgcctgcgaaacatgcaccaaaaccaacttggtcatggtcttcggagaaatcacgaccaaggccaatgttgactacgagaagatagtgcgtgacacctgcaggaacatcggctttgtctcaaac

SEQ ID NO: 1855 - DNA, 293 bp, Glycine max
  unsure (1)..(293): unsure at all n locations
tcgcatgcacgcntacgtaagctcggaattcggctcgagnganattggtgctggtgaccagggtcacatgtttggctatgccactgatgaaacccctgaattgatgccattgagccatgttcttgcaacaaaactcggtgctcgtctcaccgaggttcgcaagaacggtacctgcccttggctgaggcctgatgggaagacccaagtgaccgttgagtattacaatgacaatggtgccagggttcctattcgtgtacacaccgtgcnnaatctccacccaacacgacgagnct

SEQ ID NO: 1856 - DNA, 306 bp, Glycine max
  unsure (1)..(306): unsure at all n locations
naaangtcgcatgcacgcgtacgtaagctcggaattcggctcgagtgaccgttgagtattacaatgacaatggtgccagggttcctattcgtgtacacaccgtgctaatctccacccaacacgacgagtnctgtcaccaatgacgaaattgctgctgacctcaaagagcatgtgatcaagcctgtgatcccagagaagtaccttgatgagaagaccattttccaacttgaacccttcaggccgttttgtcattggtggccctcatggcgatgctggtctcaccggccgcaagatcattatcgatac

SEQ ID NO: 1857 - DNA, 294 bp, Glycine max
  unsure (1)..(294): unsure at all n locations
gcangcaggggtacgtnagctcggaattcggctcgagggnaggttggtgctggtgaccagggtcacatgtttggctatgccactgatgaaacccctgagtacatgcccctcagccatgtccttgcaaccaaactcggtgctcgcctcaccgaggttaggaaaaatggtactgtgcttggctgaggccagatggcaagacacaagtaactgttgagtactacaatgacaatggtgccatggttccagttcgtgtccacactgtcctaatttccacacaacatgncnnnaccganc

SEQ ID NO: 1858 - DNA, 394 bp, Glycine max
  unsure (1)..(394): unsure at all n locations
gagaagacgacagaagggggcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccaagacagcaaagttgcctgcgaaacatgcaccaaaaccaacttggtcatggtcttcggagaaatcacgaccaaggccaacgttgactacgagaagatagtgcgtgacacctgcangaacatcggcttcgtctcaaatgatgtgggactggatgcc

SEQ ID NO: 1859 - DNA, 307 bp, Glycine max
  unsure (1)..(307): unsure at all n locations
cgcatgcacgcgtacgtaagctcggaattcgggctcgagctctgatgatgttggtcttgatgctgacaaatgcaaggtgttggtcaacnttgagcagcagagccctgatatcgcccagggtgtgcacggtcactttcaccaagcgcccagaggaggttggtgctggtgnccagggtcacatgtttggctatgccactgatgaaacccctgagtacatgcccctcagccatgtccttgcaaccaaactcggtgctcgcctcaccgagttaggaaaaatggtacctgtgcttggctgaggccagatngc

SEQ ID NO: 1860 - DNA, 493 bp, Glycine max
  unsure (1)..(493): unsure at all n locations
gnaactcttaccggccangtaccgttaangagccccggntcgacannacgcgttagtccggctgcgaagaaaacgacagaagggggcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaanggcaacgttgactacnanaannaaattncntgacacctgcaggaacatcggcttcgtctcaaatgatgtgggactgggatgccgacaactgcaangtcctcgtcaacattgagca

SEQ ID NO: 1861 - DNA, 489 bp, Glycine max
  unsure (1)..(489): unsure at all n locations
ggctttnnngcccngtnnaatcttacaggncaggtaccggtacggaattcccggctcgacccacgcgtacgtacggctgcgagaagacgacagaagggggcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaangccaacgttgactacgaaaaagataattccttaacacctgcaggaacatcggcttcgtctcaaatgatgtgggactggatgccgacaactgcaaggt

SEQ ID NO: 1862 - DNA, 300 bp, Glycine max
  unsure (1)..(300): unsure at all n locations
gtcgcatgcacgcgtacgtnagctcggaattcggctcgagcagaacatcgnttcgtctcaaatgatgtgggactggatgccgacaactgcaaggtacctcgtacaacattgagcagcagagccctgatattgctcagggtgtacacggccaccttaccaaaaaacctgaagaaattggtgctggtgaccagggtcacatgtttggctatgccactgatgaaacccctgaattgatgccattgagccatgttcttgcaacaaaactcggtgctcgtctcaccgaggttcgcaagaacggta

SEQ ID NO: 1863 - DNA, 330 bp, Glycine max
  unsure (1)..(330): unsure at all n locations
ncatgcacgcgtacgtaagctcggaattcggctcgagcttctacctctcaagtttttgaagtatagagatggcagagacattcctatttaccttcagagtcagtgaacgagggacaccctgacaagctctgtgaccaaatctctgatgctgtcctcgacgcttgcctcgaacaggacccagacagcaaggttgcctgcgaaacntgcaccaaaaccaacttggtcatggtcttcggagaaatcacgaccaaggccaatgttgactacgagaagatagtgcgtgacacctgcaggaacatcggctttgtctcaaacgatgtgggactggat

SEQ ID NO: 1864 - DNA, 308 bp, Glycine max
  unsure (1)..(308): unsure at all n locations
cgcatgcacgcgtacgtaagctcggaattcggctcganctcgagccgaattcngctcgagttcggctcgagcatggtggagntgccttttcagggaaagnccctaccaaggttgacagaagtggtgcctatatcgtgaggcaggctgcaaagagtgttgtggcaaatggccttgccagaaggtgcattgtccaagtttcctatgccattggtgtccctgagcccttgtcagtgtttgtggacacttatggaactgggaagattcctgacaaggagattcttcaaattgtgaaggagaattcgacttca

SEQ ID NO: 1865 - DNA, 288 bp, Glycine max
  unsure (1)..(288): unsure at all n locations
gtngcangcgtacgtaagctcggaattcggctcgaggccttgccagaaggtgcattgtccaagtttcctatgccattggtgtccctgagcccttgtcagtgtttgtggacacttatggaactgggaagattcctgacaaggagattcttcaaattgtgaaggagaatttcgacttcagacctggaatgatcaccattaacttggaccttaagaggggtggccataggttcctcaagacagctgcttatggacactttggaagggatgaccctgacttcacctgggaag

SEQ ID NO: 1866 - DNA, 281 bp, Glycine max
  unsure (1)..(281): unsure at all n locations
gcgtacgtnagctcggaattcggctcgagngcaagtttcctatgccattggtgtccctgagcccttgtcagtgtttgtggacacttatggaactgggaagattcctgacaaggagattctgcaaattgtgaaggagaatttcgacttcagacctggaatgatcaccattaacttggaccttaagaggggtggtcataggttcctcaagacagctgcttatggacactttggaagggatgatgcagacttcacctgggaagttgtgaagccactcaagtcag

SEQ ID NO: 1867 - DNA, 353 bp, Glycine max
  unsure (1)..(353): unsure at all n locations
acttaacaacagcacaaagcgggttactgtctgttcaagctaccatctctgctctctctntcttagtgcctcnttnccagaagttaaaaatggcccaagaaactttcctattcacancctgaatcagtgaacgaggggcaccctgacaagctctgtgaccagatctccgatgctgtgctcgatgcatgcttgagcaggaccctgacagcaaggttgcctgtgaaacctgcaccaagacnaacatggtgatggttttcggagagatcacaaccaangccaacgtggactatgaggagattgtgngtgacacatgcaagaacattggtttgtctccgatgatgtnngtcttnntg

SEQ ID NO: 1868 - DNA, 502 bp, Glycine max
  unsure (1)..(502): unsure at all n locations
aattttcacgccgnccaggtancggtcanagaattcccggggncgacccacgcgtccncggacgcgtgggcggacgcgtgggcggacgcgtgggcggctgcgagaagacgacagaagggggcagcgcttgagaccaagccccactcaaccaccacaccactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaaagaccaacttggtcatggtcttcggagagattaacancaaaggccaacgttgactacgaagaagatcgtgcgtgacacctgcaggaacatcggctccgtctcaaacgatgtgggacttgatgctgacaactgcaangtccttgtaacaatgaaca

SEQ ID NO: 1869 - DNA, 322 bp, Glycine max
  unsure (1)..(322): unsure at all n locations
naangnagangtcgcatgcacgcgtacgtaagctcggaattcggctcgaggtttttgaagtatagagatggcagagacattcctatttccctcagagtcagtgaacgagggacaccctgacaagctctgtgaccaaatctctgatgctgtcctcgacgcttgcctcgaacaggacccagacagcaaggttgcctgcgaaacatgcaccaaaaccaacttggtcatggtcttcggagaaatcacgaccaaggccatgttgactacgagaagatagtgcgtgacacctgccggaacatcggctttgtctcnaacgatgtgggat

SEQ ID NO: 1870 - DNA, 418 bp, Glycine max
  unsure (1)..(418): unsure at all n locations
tactgtctgttcaagctaccatctctctctctctttcttagtgcctccttgccagaagttaaaatggcccaagaaactttcctattcacatctgaatcagtgaacgaggggcaccctgacaagctctgtgaccagatctncgatgctgtgctcgatgcatgcttggagcaggaccctgacagcaaggttgcctgtgaaacctgcaccaagaccaacatggtgatggttttcggagagatcacaaccaaggccaacgtggactatgagaaagattgtgcgtgacacatgcaggaaccattgggttttgctctgatgaatgtggtcttggatgcttgacactgcaaggtcctcgtcaacatttgagcaacagaagtcctgatantgnttcaaggtgtgcacgggcaccttacaaaagang

SEQ ID NO: 1871 - DNA, 261 bp, Glycine max
  unsure (1)..(261): unsure at all n locations
tacctctcaagtttttgaagtatagagatggcagagacattcctatttacctcagagtcagtgaacgagggacaccctgacaagctctgtgaccaaatctctgatgctgtcctcgacgcttgcctcgaacaggacccagacagcaaggttgcctgcgaaacatgcaccaaaaccaacttggtcatggtcttcggagaaatcacgaccaaggccaatgttgactacgagaagatagtgcgtgacacctgcaggnacatcggg

SEQ ID NO: 1872 - DNA, 277 bp, Glycine max
  unsure (1)..(277): unsure at all n locations
acgtcgcatgcacgcgtacgtaagctcggaattcggctcgagcgaggggcaccctgnacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgagaagattgtgcgtgacacatgcaggaacattggttttgtctctgatgatgttggtcttgatgctgacnactg

SEQ ID NO: 1873 - DNA, 291 bp, Glycine max
  unsure (1)..(291): unsure at all n locations
ctgnacgnntgctcggaattcggctcgagaccaaggccaacgttgactacgagaagatagtgcgtgacacctgcaggaacatcggcttcgtctcaaatgatgtgggactggatgccgacaactgcaaggtcctcgtcaacattgagcanncagagccctgatattgctcagggtgtacacggccaccttaccaaaaaacctgaagaaattggtgctggtgaccagggtcacatgtttggctatgccactgatgaaacccctgattgatgccattgagccatgttcttgcaa

SEQ ID NO: 1874 - DNA, 287 bp, Glycine max
tagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgctgtgaaacctgcaccaagaccaacatggtgatggttttcggagagatcacaaccaaggccaacgtggatatgagaagatgtgcgtgacacatgcaggaacattggttttgctctgatgagttggcttgatgctg

SEQ ID NO: 1875 - DNA, 262 bp, Glycine max
tcgcatgcacgcgtacgtaagctcggaattcggctcgagccaaggttgataggagtggtgcctacattgtgaggcaagctgcaaagagcattgttgcaaatggacttgctaggagggcaattgtgcaagtttcctatgccattggtgtgcctgagccctgtctgtgtttgttgacacttatggcactgggaagatccctgacaaggaaatcctcagcattgtgaaggagagttttgacttcaggcctggcatgatctccatc

SEQ ID NO: 1876 - DNA, 315 bp, Glycine max
  unsure (1)..(315): unsure at all n locations
tcncangcacgcgtacgtaagctcggaattcggctcgagggggnanctgacaagctctgtgancagatctccgatgctgtgctcgatggcatgcttggagcaggacccntacagcaangttgcctgtganacctgnancaagaccaacatggtgatggtttncngagagatcanaaccaaggccaacgtggactatgagaagattgtgcgtgacacatgcaggaacattggttttgtctctgatgatgttggtctgatgctgacaatgcanagtcctcgtcaacattgagcnacagagtcctgatattgctcaag

SEQ ID NO: 1877 - DNA, 489 bp, Glycine max
  unsure (1)..(489): unsure at all n locations
ggnngnntnnnggnaaactttcacttgccgcgnccaggtaanggtcaggaattcccgggtcgacccacgcgtccgtacggctgcgagaagacgacagaagggggcagcgcttnagatnannccccactcaaccaccacaccactctctctgctcttcttctacctttcaagtttttaaagtattaagatggcagagacattcctatttacctcagagtcagtgaacgagggacaccctgacaagctctgcgaccanatctccgatgctgtcctcgacgcttgccttgaacangacccagacagcaaggttgcctgcgaaacatgcaccaanaccaacttggtcatggtcttcggagaagatnancaccaaggccaacgttgactacgaagaagatcgtgcgttgacacctgcangaacatcggcttccgtctcaaacgatgtgggacttgatgctgacaactgcaanggtcttgtnaacattgancacc

SEQ ID NO: 1878 - DNA, 468 bp, Glycine max
  unsure (1)..(468): unsure at all n locations
actttacgntgccangtcccggtcangaatncccgggtcgacccacgcgtcngacggctgcgagaagacgacagaagggggcagcgcttgagaccaagccccactcaaccaccacaccactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagaagatnaccaccaaggccaacgttgactacgaagaagatngtgcgtgacacctgcangaacatcngcttcgtctcaaaagaatttggacttgatcctgaacaactgcaaaggtcccttgtaaacaatnaancacc

SEQ ID NO: 1879 - DNA, 300 bp, Glycine max
  unsure (1)..(300): unsure at all n locations
acgtcgcangcacgcgtacgtaagctcggaattcggctcgagcccccgagtacatgcccctcagccatgtccttgcaaccaaacttggtgctcgcctcacagaggttaggaagaatggcacctgtgcttggttgaggccagatggtaagacacaagtaaccgtcgagtactacaatgacaatggtgccatggttccagttcgtgtccacactgtcctaatttccacccaacatgatgngacgtgagcaatgatcaaattgctgcggaccttaaagagcatgttatcaagcctgtcattcc

SEQ ID NO: 1880 - DNA, 477 bp, Glycine max
  unsure (1)..(477): unsure at all n locations
ttcnaactcntaccgcccaggaaccggtacaagaattcccggctcgacccacgcgtcangtacggctgcgagaagacgacagaagggggcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacgagaagatagtgcgtgacacctgcaagaacaaccggtttctcccnaattgaatntgggactggatgccgacaactgcaang

SEQ ID NO: 1881 - DNA, 259 bp, Glycine max
  unsure (1)..(259): unsure at all n locations
tgcccttggctgagacctgatggcaagacccaagtcactgttgagtactacaatgacaagggtgccatggttccaatccgcgtccacactgtgctcatctccacacagcatgatgagnctgtcacaaatgntgagattgcagctgatcttaaagaacacgtgattaagcctgtgattcctgagaagtaccttgatgagagaccatttccatttgaacccttccnggcaggttgtcattggagggcggcatggggatgng

SEQ ID NO: 1882 - DNA, 254 bp, Glycine max
  unsure (1)..(254): unsure at all n locations
ccngggtcacntgtttggctntgccncggacgagaccccngnnttgatgccattgngtcatgttcttgcnactnanctcggtgctcgtctcaccgaggttcgcnagaacggaacctgcccntggttgaggcctgatgggaagacccaagtgactgttgagtattacnntgacaacggtgccatngttccagttcgtgtccncactgtgcttatctccacccaacntgatgngntgngaccaacgacgaaattgc

SEQ ID NO: 1883 - DNA, 279 bp, Glycine max
  unsure (1)..(279): unsure at all n locations
nanactnaatgcacgcgtacgtaagctcggaattcggctcgagagacagcaaagttgcctgcgaaacatgcaccaaaaccaacttggtcatggtcttcggagaaatcacgaccaaggccaacgttgactacgagaagatagtgcgtgacacctgcaggaacatcggcttcgtctcaaatgatgtgggactggatgccgacaactgcaaggtcctcgtcaacattgagcagcagagccctgatattgctcagggtgtacacggccaccttaccaaaaaac

SEQ ID NO: 1884 - DNA, 313 bp, Glycine max
  unsure (1)..(313): unsure at all n locations
tcgcangcacgcgtacgtaagctcggaattcggctcgagctcgagccgtatctctctgttctcttctacctctcaagtttttgaagtatagagatggcagagacattcctatttacctcagagtcagtgaacgagggacaccctgacaagctctgtgaccaaatctctgatgctgtcctcgacgcttgcctcgaacaggacccagacagcaaggttgcctgcgaaacatgcaccaaaaccaacttggtcatggtcttcggagaaatcacgaccaaggccaatgttgactacgagaagatagtgcgtgacacct

SEQ ID NO: 1885 - DNA, 299 bp, Glycine max
  unsure (1)..(299): unsure at all n locations
acgtcgcatgcacgcgtacgtnagctcggaattcggctcgagcttctacctctcaagtttttgaagtatagagatggcagagacattcctatttacctcagagtcagtgaacgagggacaccctgacaagctctgtgaccaaatctctgatgctgtcctcgacgcttgcctcgaacaggacccagacagcaaggttgcctgcgaaacatgcaccaaaaccaacttggtcatggtcttcggagaaatcacgaccaaggccaatgttgactacgagaagatagtgcgtgacacctgcagga

SEQ ID NO: 1886 - DNA, 301 bp, Glycine max
  unsure (1)..(301): unsure at all n locations
nntaannntnagtcgcangcacgcgtacgtaagctcggaattcggctcgagaaagtataaagatggcagagacattcctatttacctcagagtcggtgaacgagggacaccctgacaagctctgcgaccanatctccgatgctgtcctcgacgcttgcctcgagcaggacccagacagcaaagttgcctgcgaaacatgcaccaaaaccaacttggtcatggtcttcggagaaatcacgaccaaggccaacgttgactacgagaagatagtgcgtgacacctgcaggaacatcggcttcgt

SEQ ID NO: 1887 - DNA, 508 bp, Glycine max
  unsure (1)..(508): unsure at all n locations
tnnnnnaactnagttctccgcngcctgnnaangtcaagangncccgggccgacccacgcgtccntacggctgcgagaagacgacagaagggggcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacgagaagatagtgcgtgacacctgcangaacatcggcttcgtctcaaaatgatgtnggactggattcccacaactgcaaagncctcccntaaaattttgccanaanccc

SEQ ID NO: 1888 - DNA, 278 bp, Glycine max
  unsure (1)..(278): unsure at all n locations
gncgcacgcgtacgtaagctcggaattcggctcgagggcaggtttgtcattggagggccgcatggcgatgctggtctcaccggccgcaagatcatcatcgacacctatggaggatggggtgcacatggtggtggtgnccttctctgggaaggatcctaccaaggttgntaggagtggtgcctacattntgaggcaagctgcaaagagcattgttgcaaatggacttgctaggagggcaattgtgcaagtttcctatgccattggtgtgcctgagccct

SEQ ID NO: 1889 - DNA, 280 bp, Glycine max
  unsure (1)..(280): unsure at all n locations
cnttggctgagacctgatggcaagacccaagtcantgttgagtactacaatgacaagggtgccatggttccaatncgcgtccacantgtgcttcatntncacacagcatgatgagtgngtnanaaatgatgagattgcagctgatcttaaagaacacgtgattaagcntgtgattnctgagaagtaccttgatgagaagaccattttccatttgaacccttntgggcaggtttgtcatggagggccgcatggcgattttggtgtnanggcngnaagatcc

SEQ ID NO: 1890 - DNA, 310 bp, Glycine max
  unsure (1)..(310): unsure at all n locations
ncncangcncgcnnncgtgagctcggnattcggctcgaggtttttgangtatagagatggcagagacattcctatttacctcagagtcagtgaacgagggacaccctganaagctctgtgaccaaatctctgatgctgtcctcgacgcttgcctcgnacaggacccagacagcaaggttgcntgcgaaacatgcaccaaaaccaacttggtgcatggtcttcggagaaatcacgaccaaggccaatgttgactacgagaagatagtgcgtgacacctgcaggaacatcggctttgtctcaaacgatgtgg

SEQ ID NO: 1891 - DNA, 290 bp, Glycine max
  unsure (1)..(290): unsure at all n locations
cagcangcacgcgtacgtaagctcggaattcggctcgagaccaacttggnatggtcttcggagaaatcacgaccaaggccaacgttgactacgagaagatagtgcgtgacacctgcaggaacantcggcttcgtctcaaatgatgtgggactggatgccgacaactgcaaggtcctcgtcaacattgagcagccgagccctgatattgctcagggtgtacacggccaccttaccaaaaaacctgaagaaattggtgctggtgaccagggtcacatgtttggctatgccat

SEQ ID NO: 1892 - DNA, 502 bp, Glycine max
  unsure (1)..(502): unsure at all n locations
tttaaactctccgcggtcaggtaacggtcngngaattcccgggncgacccangcgtccannccaggcgtcagcccaacgcgtcngtgnggctgcnagaagannacanaagggggcagcgcttgatttnaggccaggcangccccactcatccancanacctctcctcgttcangctncccctttctgcccttcntctacctttcangttttaaaagtatanagatggcagagacattcctatttacctcagagtcggtgaacgagggacaccctgacaagctctgctaccaaatctccgatgctgtcctcgacgcttgcctcgagcangacccagacagcnaagttgcctgcgaaacatncaccatanccaacttggtcatggtcttcggaganatcacgaccaaggccaacgttgactacgaagaagatagtgcgtgacacctgcaggaacatcngnttcgtctcaaattatgtgggactggatgccancanctgcaaggt

SEQ ID NO: 1893 - DNA, 286 bp, Glycine max
  unsure (1)..(286): unsure at all n locations
tcgcntgcacgcgtacgtaagctcggaattcggctcgagnaagttgcctgcganacatgcaccaanaccaacttggtcatggtcttcggagaaatcacgaccaaggccaacgttgactacgagaagatagtgcgtgacacctgcaggaacatcggcttcgtctcaaatgatgtgggactggatgccgacaactgcaaggtcctcgtcaacattgagcngcagagccctgatattgctcagggtgtacacggccaccttaccaaaaaacctgaagaaanncntgctg

SEQ ID NO: 1894 - DNA, 326 bp, Glycine max
  unsure (1)..(326): unsure at all n locations
ncgcngcacgcgtacgtaagctcggaattcggctcgagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgagaagattgtg

SEQ ID NO: 1895 - DNA, 304 bp, Glycine max
  unsure (1)..(304): unsure at all n locations
tcgnangcaagcncngaantcngcncnagcgnnnntagncnanngtgnttaccggcngcaagatcantatcgatacttatnggaggatgnngtgctcatggtngtggtgctttctccggcaaggaccctaccaaggttgataggagtggtgcttacattgtgagacaggctgctaagancattgtggcaagtggactngccagaaggtgcattgtgcaagtgtcttatgccattggtgtgcctgagcctttgtctgtgtttgttgacacctatggcactgganagatccctgacaaggagatct

SEQ ID NO: 1896 - DNA, 273 bp, Glycine max
  unsure (1)..(273): unsure at all n locations
ncgtcgcatgcacgcgtacgtnagctcggaattcggctcgagctgtgcttggctgaggccagatggcaagacacaagtaactgttgagtactacaatgacaatggtgccatggttccagttcgtgtccacactgtcctaatttccacccaacatgatgacnangtgagcaatgaccaaattgctgctgaccttaaagagcatgttatcaagcctgtcattcctgagaagtacctggatgagaagaccatcttccaccttaacccttctggccg

SEQ ID NO: 1897 - DNA, 334 bp, Glycine max
  unsure (1)..(334): unsure at all n locations
gtcgcatgcacgcgtacgtaagctcggaattcggctcgagcagcacaaagcgggttactgncctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgagaagattgtgcg

SEQ ID NO: 1898 - DNA, 293 bp, Glycine max
  unsure (1)..(293): unsure at all n locations
gtcgcngcacgcgtacgtaagctcggaattcggctcgagncctcacagaggttaggaagaatggcacctgtgcttggttgaggccagatggtaagacacaagtaaccgtcgagtactacaatgacaatggtgccatggttccagttcgtgtccacactgtcctaatttccacccaacatgacgacctgtgagccatgatcaaattgctgcggaccttaaagancatgttatcaagcctgtcattcctgagaagtaccttgatgagaagaccatcttccacttaacccttctgg

SEQ ID NO: 1899 - DNA, 316 bp, Glycine max
  unsure (1)..(316): unsure at all n locations
cacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacancaaagttgcctgcgaaacatgcaccaaaaccaacttggttcatggtcttcggagaaatcacgaccaaggccaacgttgactacgagaagatagtgcgtgacacctgcaggaacatcggcttcgtctcaaatga

SEQ ID NO: 1900 - DNA, 279 bp, Glycine max
  unsure (1)..(279): unsure at all n locations
ttcctatttacctcagagtcggtgaacgagggacaccctgacaagctctgcgaccaaatctccgatgctgtcctacgacgcttgcctcgagcaggacccagacagcaaagttgcctgcgaaacatgcaccaaaaccaacttggtcatggtcttcggagaaatcacgaccaaggccaacgttgactacgagaagatagtgcgtnacactggagganacatgggcttcgtctnaaatgntgngggactggatcccganaantgaaggtcncgaaaatntga

SEQ ID NO: 1901 - DNA, 285 bp, Glycine max
cgctgcacgcgtacgtaagctcggaattcggctcgagatgctgtcctcgacgcttgcctcgagcaggacccagacagcaaagttgcctgcgaaacatgcaccaaaaccaacttggtcatggtcttcggagaaatcacgaccaaggccaacgttgactacgagaagatagtgcgtgacacctgcaggaacatcggcttcgtctcaaatgatgtgggactggatgccgacaactgcaaggttcctcgttcaacattgagcagcagagccctgatattgctcagggtg

SEQ ID NO: 1902 - DNA, 282 bp, Glycine max
gtcgcatgcacgcgtacgtaagctcggaattcggctcgagcaggacccagacagcaaagttgcctgcgaaacatgcaaaaaccaacttggtcatggtcttcggagaaatcacgaccaaggccaacgttgactacgagaagatagtgcgtgacacctgcaggaacatcggcttcgtctcaaatgatgtgggactggatgccgacaactgcaaggtcctcgtcaacattgagcagcagagccctgatattgctcagggtgtacacggccaccttaccaaaaaac

SEQ ID NO: 1903 - DNA, 476 bp, Glycine max
  unsure (1)..(476): unsure at all n locations
tttactnnnccngngccatgtaanagtanagaagtcccgggccgacccacgngtcnntacggctgcgagaagacgacagaagggggcagcgcttgatttgaggccaggcaagccccactcaaccaccacacctctcctcgttcacgctacccctttctgctcttcttcnacctttcaagttttaaaagtataaagatggcagagacattcctatttacctcagagtcggtgaacgagggacaccctgacaagctctgcgaccaaatctccgatgctgtcctcgacgcttgcctcgagcatgacccagacagcaaagttgcctgcgaaacatgcaccagaaccaacttggtcatggtcttcggagaaatcacgaccatgggcaacgttgactaccagaagataagtgcgtgacacctgcaggaacatcggnttcgtctcaaatgatgtgggactggatgccnacaatctgganangg

SEQ ID NO: 1904 - DNA, 496 bp, Glycine max
  unsure (1)..(496): unsure at all n locations
aactttcgtgccagnccggtcaagaatnccgggtcgacccacgcgtccgtacggctgcgagaagacgacagaagggtacggctgcgagaagacgacagagggggcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacgaagaagatagtgcgtgacacctgcaggaacatcggcttcgtctcaaatgatgtgggactgggatgccgacaactgcaangtcct

SEQ ID NO: 1905 - DNA, 247 bp, Glycine max
  unsure (1)..(247): unsure at all n locations
nannatcgcntgcacgcgtacgtnagctcggaattcggctcgagnntggattcatctctgatgatgttggtcttgatgctgacaaatgcaaggtgttggtcaacattgagcagcagagccctgatatcgcccagggtgtgcacggtcacttcaccaagcgcccagaggaggttggtgctggtgaccagggtcacatgtttggctatgccactgatgaaacccctgagtacatgcccctcagccatnt

SEQ ID NO: 1906 - DNA, 308 bp, Glycine max
  unsure (1)..(308): unsure at all n locations
atncacatgtcacangcacgcgtacgtaagctcggaattcggctcgagnctntcncttgtntgtgnatgctgacacttatggcactgggaagatccctgacaaggaaatcctcagnattgtgaaggagagttttgacttcaggcctggnntgatctccatcaaccttgntctcaagaggggtggaaatggcaggttcttgaagactgctgcatatggncactttggcaganatgacccngacttcacatgggaantggtnangcgactcaagggggannaggtaccagcttanctanaagggnctcct

SEQ ID NO: 1907 - DNA, 292 bp, Glycine max
  unsure (1)..(292): unsure at all n locations
ancgnactgcacgcgtacgtaagctcggaattcggctcgagaaagtataaagatggcagagncattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacgagaagatatngngtgacacctgcaggaacatcggcttcgtc

SEQ ID NO: 1908 - DNA, 300 bp, Glycine max
  unsure (1)..(300): unsure at all n locations
agtcgcangcacgcgtacgtaanctcggaattcggctcgaggtttggctatgccactgtatgaaacccctgagtacatgcccctcagccatgtccttgcaaccaaactcggtgctcgcctcaccgaggttaggaaaaatggtacctgtgcttggctgaggccagatggcaagacacnagtaactgttgagtactacaatgacaatggtgccatggttccagttcgtgtccacactgtcctaatntncacccaacatgatganncngtgagcaatgaccaaattgctgctggaccttaaag

SEQ ID NO: 1909 - DNA, 458 bp, Glycine max
  unsure (1)..(458): unsure at all n locations
atttcaggtggtcttataggccaanaatgacgtaagacgcacgcgtncgtaanctcggaattcggctcgagggccanggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccanacagcaaagttgcctgcgaaacatgcaccaaaaccaacttggncatggtcttcggagaaatcacgaccaaggccaacgttgactacgagaagatagtgcgtgacacctgcaggaacatcgggcttcgtctcaaatgatgtgggactggatgccgacaantgcaangttctcgtcaacant

SEQ ID NO: 1910 - DNA, 308 bp, Glycine max
  unsure (1)..(308): unsure at all n locations
ngncncangcncgcntacgtnanctcggaattcggctcgagctaccatcttctctctctcttncttagtgcctccttgccagangtnaaaatggcccaagaaacttncctatncacatctgantcagtgaacgaggggcaccctgacaagctctgtgaccagatctccgatgctgtgctcgntgcatgcttggagcaggaccctgacagcaaggttgcctgtgaaacctgcaccaagaccaacatggtgatggttttcggagagatcacaaccaaggccaacgtggactatgagaagattgtgcgtga

SEQ ID NO: 1911 - DNA, 306 bp, Glycine max
  unsure (1)..(306): unsure at all n locations
cgtgtacgtaagctcggaattcggctcgagaagtttttgaagtatagagatggcagagacattcctatttacctcagagtcagtgaacgagggacaccctgacaagctctgtgaccaaatctctgatgctgtcctcgacgcttgcctcgaacaggacccagacagcaaggttgcctgcgaaacatgcaccaaaaccaacttggtcatggtcttcggagaaatcacgaccaaggccaatgtngactacgagaagatagtgcgtgacactgcaggacatnggtttgtccnaacgngnggncngncccc

SEQ ID NO: 1912 - DNA, 504 bp, Glycine max
  unsure (1)..(504): unsure at all n locations
aatgncaaactncncagccgncctgncnnggtcatagggnccgacngacccgtccnaaccacgnatccgctgncacntgngcngacgcgtgggctgcnagaagacgacagaagggggcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaangccaacgttgactacgagaagatagtgcntgacacctgcacggaaatngggttcntctcaattaatttggaacgggtttcccnaaaactncaagg

SEQ ID NO: 1913 - DNA, 289 bp, Glycine max
  unsure (1)..(289): unsure at all n locations
tcnatgcacgcgtacgtaagctcggaattcggctcgagtcaaggtgtgcacggccaccttcacaaagaggcctgaggagattggtgctggtgaccaaggtcatatgttcggctatgccactgacgagactcccgagctcatgcccttgagccatgtccttgccacgaagccggtgccaagctcaccgaggttcggaagaacgggacatgcccttggctgagacctgatggcaagacccaagtcactgttgagtactacaatgacaagggtgccatggttccaatccgcg

SEQ ID NO: 1914 - DNA, 345 bp, Glycine max
  unsure (1)..(345): unsure at all n locations
gnattgnagtacgcgtacgtnagctcggaattcggctcgnggacttaacaacaacncanagngggttanngtctgttcaagctaccatctctctctctctttcttagtgnctccttgcnagaagttaanatggcccaaganactttcctattcacatctgaatcagtgaacgaggggcaccctgacaagctctgtgaccanatctccgatgctgtgctcgatgcatncttggagcaggaccctgacagcaaggttgcctgtgaaacctgcaccaanacnaacatggtgattgttttcggagagatcacaaccaaggccaacgttgactatgagaagattgtgcnt

SEQ ID NO: 1915 - DNA, 331 bp, Glycine max
  unsure (1)..(331): unsure at all n locations
gtcgcatgcacgcgtacgtaagctcggaattcggctcgagcttaacaacagcacaaagcgggttactgtctgttcaagctaccatctctctctctctttcntagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgaga

SEQ ID NO: 1916 - DNA, 244 bp, Glycine max
  unsure (1)..(244): unsure at all n locations
tcgcangcacgcgtacgtaagctcggaattcggctcgagccaaggccaacgtagactatgaaaagattgtccgcgacacatgccgcgaaattggattcatctctgatgatgttggtcttgatgctgacaaatgcaaggtgttggtcaacattgagcaacagagcccggatatcgcccagggtgtgcacggccacttcaccaagcgcccagaggaggttggtgctggtgaccagggtcacntgtt

SEQ ID NO: 1917 - DNA, 290 bp, Glycine max
  unsure (1)..(290): unsure at all n locations
nnngtngcatgcncgcgtacgtaagctcngnntncggctctntgcctatatcgtgagncaggctgcnaagagtgttgtggnaaatggccttgccagaaggtgcattgtccnagtttcctatnccattggtgtccctgagcccttgtcagtgtttatggacacttatggaactgggaanattcctgacaaggngattcttcaaattgtgnaggagaatttcgacttcagacctggaatgatcaccattaacttggaccttaagaggggtggccataggttcctcaagacag

SEQ ID NO: 1918 - DNA, 314 bp, Glycine max
  unsure (1)..(314): unsure at all n locations
nnaagttnangcacgcntacgtaagctcggaattcggctcgaggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgagaa

SEQ ID NO: 1919 - DNA, 311 bp, Glycine max
  unsure (1)..(311): unsure at all n locations
tattcnnnacgtcgcatgcacgcgtacgtaagctcggaattcggctcgagcactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccaaggccaacgttgactacgagaagatcgtgcgtg

SEQ ID NO: 1920 - DNA, 281 bp, Glycine max
  unsure (1)..(281): unsure at all n locations
ngcangcacgcgtacgtaagctcggaattcggctcgaggcctcgagcaggacccagacagcaaagttgcctgcgaaacatgcaccaaaaccaacttggtcatggtcttcggagaaatcacgaccaaggccaacgttgactacgagnagatagtgcgtgacacctgcaggaacatcggcttcgtctcaaatgatgtgggactggatgccgacaactgcaaggtcctcgtcaacattgagcagcaganccctgatattgctcagggtgtnncccggccacctt

SEQ ID NO: 1921 - DNA, 315 bp, Glycine max
  unsure (1)..(315): unsure at all n locations
tccgaagtctcangcacgcgtacgtaagctcggaattcggctcgagntacctatggtgggtggggtgctcatggtggaggtgccttttcagggaaggaccctaccaaggttgacagaagtggtgcctatatcgtgaggcaggctgcaaagagtgttgtggcaaatggccttgccnaaanggtgcnntggccnangtttcnaaggccatnggtgtccctgagcccttgtcagtgtttgtggacacttatggaactgggaagattcctgacaaggngnttcttcaaattgtgaaggnganttcngncttcngacntg

SEQ ID NO: 1922 - DNA, 259 bp, Glycine max
  unsure (1)..(259): unsure at all n locations
gtcgcangcacgcgtacgtaagctcggaattcggctcgagggtggaggtgccttttcagggaaggaccctaccaaggttgacagaagtggtgcctatatcgtgaggcaggctgcaaagagtgttgtggcaaatggccttgcagaaggtgcattgtccaagtttcctatgccattggtgtccctgagcccttgtcagtgtttgncgacacttatggaactgggaagattcctgacaaggagattcttcaaattgtgaagg

SEQ ID NO: 1923 - DNA, 300 bp, Glycine max
  unsure (1)..(300): unsure at all n locations
agtcgcatgcacgcgtacgtaagctcgggaattcggctcgagacctctcaagtttttgaagtatagagatggcagngacattcctatttacctcagagtcagtgaacgagggacaccctgacaagctctgtgaccaaatctcatgctgtcctcgacgcttgcctcgaacaggacccagacagcaaggttgcctgcgaaacatgcaccaaaaccaacttggtcatggtcttcggagaaatcacgaccaaggccaatgttgactacgagaagatagtgcgtgacacctgcaggaacatcggt

SEQ ID NO: 1924 - DNA, 290 bp, Glycine max
  unsure (1)..(290): unsure at all n locations
anncgcangcacgcgtacgtaagctcggaattcggctcgagtcaagtttntgaagtatagagatggcagagacattcctatttacctcagagtcagtgaacgagggacaccctgacaagctctgtgaccaaatctctgatgctgtcctcgacgcttgcctcgaacaggacccagacagcaaggttgcctgcgaaacatgcaccaaaaccaacttggtccatggtcttcggagaaatcacgaccaaggccaatgttgactacgagaagatagtgcgtgacacctgcaggaa

SEQ ID NO: 1925 - DNA, 294 bp, Glycine max
  unsure (1)..(294): unsure at all n locations
ngtcgcatgcacgcgtacgtaagctcggaattcggctcgagcggctcgagcggctcgagggcaaatggccttgccagaaggtgcattgtccaagtttcctatgccattggtgtcnctgagcccttgtcagtgtttgtggacacttatggaactgggaagattcctgacaaggagattcttcaaattgtgaaggagaatttcgacttcagacctggaatgatcaccattaacttggaccttaagaggggtggccataggttcctcaagacagctgcttatggacactttggaagg

SEQ ID NO: 1926 - DNA, 473 bp, Glycine max
  unsure (1)..(473): unsure at all n locations
anctttgtacgcgccccaggtaccggtaaaggaattccnggctcgacccacgcgtaagcccacgcgtccgtacggctgcgagaagacgacagaagggggcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacgagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacgaagaagatagtgcgtgacacctgcangaacatcggcttcgtctcaaatgatgttggaactggatgc

SEQ ID NO: 1927 - DNA, 490 bp, Glycine max
  unsure (1)..(490): unsure at all n locations
atttnaccttcccgngcccngtaaaggtcaaaganttcccgggncgacccacgcgtccgcccacgcgtccgtacggctgcgagaagacgacagaaggggggcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacgaagaagatagtgcgtgacacctgcaggaacatcggcttcgtctcaaaatgatgtgggactggatgccgacaactgnnangg

SEQ ID NO: 1928 - DNA, 320 bp, Glycine max
  unsure (1)..(320): unsure at all n locations
aanagtcgcangcacgcttacgtnaagctcggaattcggctcgagaaagcgggntactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgn

SEQ ID NO: 1929 - DNA, 294 bp, Glycine max
  unsure (1)..(294): unsure at all n locations
gtcgcatgcacgcgtacgtaagctcggaattcggctcgagggagattctcaacattgtgaaggaaaactttgatttcaggcctggtatgatctccatcaaccttgatctcaagaggggtggaaataacaggtttttgaagactgctgcctatggacactttggaagagaagaccctgacttcacatgggaagtggtcaaacccctcaagtgggagaaggcctaagtaattcattccactgctctatgctggaagttttttgagcgttgcccttataatatgtctaatatccatn

SEQ ID NO: 1930 - DNA, 304 bp, Glycine max
gtcgcatgcacgcgtacgtaagctcggaattcggctcgagggagattctcaacattgtgaaggaaaactttgatttcaggcctggtatgatctccatcaaccttgatctcaagaggggtggaaataacaggtttttgaagactgctgcctatggacactttggaagagaagaccctgacttcacatgggaagtggtcaaacccctcaagtgggagaaggcctaagtaattcattccactgctctatgctggaagttttttgagcgttgcccttataatatgtctaatatccataactttccacg

SEQ ID NO: 1931 - DNA, 321 bp, Glycine max
  unsure (1)..(321): unsure at all n locations
cgcatgcacgcgtacgtnagctcggaattcggctcgagcttctacctctcaagtttttgaagtatagacnncggcagagacattccctatttaccttcagagttcagtgaacgagggacacnctgacaagctctgtgaccaaatctctgatgctgtcctcgacgcttgcctcgaacaggacccagacagcnaggttgcctgcgaaacatgcaccaaaaccaacttggtcatggtcttcggagaaatcacgaccaaggccaatgttgactacgagaagatagtgcgtgacacctgcaggaacatcggctttgtctcaaacga

SEQ ID NO: 1932 - DNA, 281 bp, Glycine max
  unsure (1)..(281): unsure at all n locations
cgcatgcacgcgtacgtaagctcggaattcggctcgagcttctacctctcaagtttttgaagtatagagatggcagagacattcctatttacctcagagtcagtgaacgagggacaccctgacaagctctgtgaccaaatctctgatgctgtcctcgacgcttgcctcgaacaggacccagacagcaaggttgcctgcgaaacatgcaccaaaaccaacttggtcatggtcttcggagaaatcacgaccaaggccaatgttgactacgagaaganagtgcg

SEQ ID NO: 1933 - DNA, 292 bp, Glycine max
  unsure (1)..(292): unsure at all n locations
natacatgcacgcgtacgtaagctcggaattcggctcgagctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccaaggccaacgttgactacgagaagatcgt

SEQ ID NO: 1934 - DNA, 266 bp, Glycine max
  unsure (1)..(266): unsure at all n locations
ctctgcgnccaaatctccgatgctgtcctcgacgcttgccttgaacaggacccagacagcaaggttgcctgcgaaacatgcaccaagaccaacttggtcatggtcttcggagagatcaccaccaaggccaacgttgactacgagaagatcgtgcgtgacacctgnaggaacatcggcttcgtctcaancgatgtgggacttgatgctgacaactgccaaggtncntgnnaacattgaggnnncagagccctggatattgcccaggg

SEQ ID NO: 1935 - DNA, 310 bp, Glycine max
  unsure (1)..(310): unsure at all n locations
cgcnnaangcgtacgtnagctcggaattcggctcgagncgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactatgag

SEQ ID NO: 1936 - DNA, 299 bp, Glycine max
  unsure (1)..(299): unsure at all n locations
gtcgcangcacgcgtacgtaagctcggaattcggctcgaggcaacagagtcctgatattgctcaaggtgtgcacggccacctcacaaagaggcctgaggagattggtgctggtgaccaaggtcatatgttcggctatgccactgacgagactcccgagctcatgcccttgagccatgtccttgccacgaagctcggtgccaagctcaccgaggttcggaagaacgggacatgcccttggctgagacctgatggaccactgntgantgattacgatcacgattaattcggccccgacagt

SEQ ID NO: 1937 - DNA, 311 bp, Glycine max
  unsure (1)..(311): unsure at all n locations
ncnnacgcangcacgcgtacgtnagctcggaattcggctcgagctctcaagtttttgaagtatagagatggcagagacattcctatttacctcagagtcagtgaacgagggacaccctgacaagcttctgtgaccnaaatctctgatgctgtcctcgacgcttgcctcgaacaggacccagacagcaaggttgcctgcgaaacatgcaccaaaaccaacttggtcatggtcttcggagaaatcacgaccaaggccaatgttgactacgagaagatagtgcgtgacacctgcaggaacatcggctttgtctt

SEQ ID NO: 1938 - DNA, 319 bp, Glycine max
  unsure (1)..(319): unsure at all n locations
gatgcacgcgtacgtaagctcggaattcggctcgagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaangttgcctgtgaaacctgcaccaagaccaacatggtatggttttcggagagatcacaaccaaggccaacgtggactatgagaagat

SEQ ID NO: 1939 - DNA, 315 bp, Glycine max
  unsure (1)..(315): unsure at all n locations
gtcgcatgcacgcgtacgtaagctcggaattcggctcgagcggctcgaggcacgctctgcttccagcgagtgttctttcttcgtttcaacaccttaatttgcanacgctgcttcttcccgcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggtcatggtctttggagagatcacaaccaagg

SEQ ID NO: 1940 - DNA, 303 bp, Glycine max
  unsure (1)..(303): unsure at all n locations
cgcangcacgcgtacgtaagctcggaattcggctcgaggtcttgatgctgacaactgcaaggtcctcgtcaacattgagcaacagagtcctgatattgctcaaggtgtgcacggccacctcacaaagaggcctgaggagattggtgctgntgaccaaggtcatatgttcggctatgccantganganactcccgagctcatgcccttgagccatgtccttgccacgaagctcggtgccaagtctcaccgaggttnggnagaacgggacatcccctgggntgagacntgntggcaaagnccaaa

SEQ ID NO: 1941 - DNA, 335 bp, Glycine max
  unsure (1)..(335): unsure at all n locations
tcgctgcacgcgtacgtaagctcggaattcngctcgaggccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacgagaagatagtgcgt

SEQ ID NO: 1942 - DNA, 285 bp, Glycine max
  unsure (1)..(285): unsure at all n locations
tcgcangcncgcgtacgtnagctcggaattcggctcgaggggattctcaacattgtgaaggaaaactttgatttcaggcctggtatgatctccatcaaccttgatctcaagaggggtggaaataacaggtttttgaagactgctgcctatggacactttggaagagaagaccctgacttcacatgggaagtggtcaaacccctcaagtgggagaaggcctaagtaattcattccactgctctatgctggaagttttttgagcgttgccctataatatgtctaata

SEQ ID NO: 1943 - DNA, 310 bp, Glycine max
  unsure (1)..(310): unsure at all n locations
ngtctcangcacncgtacgtaagctnggaattcggctcnaggtctgttcnngctaccatctctctnctctctttcttagtgcctccttgccagaagttaaantggcccaagaaactttcctattcacatctgaatnagtgaacgaggggcaccctgacaagctctgtgaccagatctccgatgctgtgctcgatgcatgcttggagcaggaccctgacagcanngttgcctgtgaaacctgcaccaagaccaacatggtgatggttttcggagagatcacnaccaaggncaacgtggactatgagaagat

SEQ ID NO: 1944 - DNA, 317 bp, Glycine max
gtcgcatgcacgcgtacgtaagctcgggaattcggctcgaggttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggtcatggtctttggagagatcacaaccaaggc

SEQ ID NO: 1945 - DNA, 331 bp, Glycine max
  unsure (1)..(331): unsure at all n locations
tngnnngcacgcgtacgtaagctcggaattcggctcgagcggctcgagtttgggagttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggtcatggtctttggagagatcacaaccaaggc

SEQ ID NO: 1946 - DNA, 314 bp, Glycine max
  unsure (1)..(314): unsure at all n locations
nncacgcgtacgtaagctcggaattcggctcgagnggagttaggttctgcacgctctgcttccagcgagtgttctttcttcgtttcaacaccttaatttgcacacgctgcttcttcngcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggtcatggtctttggagagatcacaaccaaggc

SEQ ID NO: 1947 - DNA, 306 bp, Glycine max
  unsure (1)..(306): unsure at all n locations
ctcgnatgcacgcgtacgtaagctcggaattcggctcgaggcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggtcatggtctttggagagatcacaaccaaggc

SEQ ID NO: 1948 - DNA, 297 bp, Glycine max
  unsure (1)..(297): unsure at all n locations
atgngagtcgcangcncgcgtacgtnagctcggaattcggctcgaggngattctcaacattgtgaaggaaaactttgatttcaggcctggtatgatctccatcaaccttgatctcaagaggggtggaaataacaggtttttgaagactgctgcctatggacactttggaagagaagaccctgacttcacatgggaagtggtcaaacccctcaagtgggagaaggcctaagtaattcattccactgctctatgctggaagttttttgagcgttgcccttataatatgtctaatatcca

SEQ ID NO: 1949 - DNA, 217 bp, Glycine max
gcgtacgtaagctcggaattcggctcgaggacaaatgcaaggtgttggtcaacattgagcagcagagccctgatatcgcccagggtgtgcacggtcacttcaccaagcgcccagaggaggttggtgctggtgaccagggtcacatgtttggctatgccactgatgaaacccctgagtacatgcccctcagccatgtccttgcaaccaaactcggtgc

SEQ ID NO: 1950 - DNA, 291 bp, Glycine max
  unsure (1)..(291): unsure at all n locations
agnnaangcacgcgtacgtaagctcggaattcggctcgagactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccaaggccaacgttgactacgagaaga

SEQ ID NO: 1951 - DNA, 291 bp, Glycine max
  unsure (1)..(291): unsure at all n locations
gtcgcannttngcgtacgtaagctcggaattcggctcgagactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccaaggccaacgttgactacgagaaga

SEQ ID NO: 1952 - DNA, 319 bp, Glycine max
gtcgcatgcacgcgtacgtaagctcggaattcggctcgaggttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggtcatggtctttggagagatcacaaccaaggccag

SEQ ID NO: 1953 - DNA, 288 bp, Glycine max
  unsure (1)..(288): unsure at all n locations
gtcgnangcacgcgtacgtaagctcggaattcggctcgagtctctctgttctcttctacctctcaagtttttgaagtatagagatggcagagacattcctatttacctcagagtcagtgaacgagggacaccctgacaagctctgtgaccaaatctctgatgctgtcctcgacgcttgcctcgaacaggacccagacagcaaggttgcctgcgaaacatgcaccaaaaccaacttggtcatggtcttcggagaaatcacgaccaaggccaatgttgactacgagaaga

SEQ ID NO: 1954 - DNA, 248 bp, Glycine max
acctctcaagtttttgaagtatagagatggcagagacattcctatttacctcagagtcagtgaacgagggacaccctgacaagctctgtgaccaaatctctgatgctgtcctcgacgcttgcctcgaacaggacccagacagcaaggttgcctgcgaaacatgcaccaaaaccaacttggtcatggtcttcggagaaatcacgaccaaggccaatgttgactacgagaagatatgcgtgacactgcag

SEQ ID NO: 1955 - DNA, 309 bp, Glycine max
  unsure (1)..(309): unsure at all n locations
cgcangcacgcgtacgtnagctcggaattcggctcgagntttgaacccttctggcaggtttgtcattggagggccgcatggngatgctggtctcaccggcngcaagntcancatcgacacctatgntcngatggggtgcacatggtggtggtgccttctntgggaaggatccgccaangttgataggagtggtgcctacattgtgaggcaagctgcaaagagcattgttncaaatgganttgctaggagggcaattgtgcaagtttcctatgccattggtgtgcctganccntgtctgtgnttgttnac

SEQ ID NO: 1956 - DNA, 292 bp, Glycine max
cgtcgcatgcacgcgtacgtaagctcggaattcggctcgagggtggaggtgccttttcagggaaggaccctaccaaggttgacagaagtggtgcctatatcgtgaggcaggctgcaaagagtgttgtggcaaatggccttgccagaaggtgcattgtccaagtttcctatgccattggtgtccctgagccctgtcagtgtttgtggacacttatggaactgggaagattcctgacaaggagattcttcaaatgtgaaggagaattcgacttcagacctggaatgatcaccat

SEQ ID NO: 1957 - DNA, 317 bp, Glycine max
tgcatgcacgcgtacgtaagctcggaattcggctcgagtaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtg

SEQ ID NO: 1958 - DNA, 219 bp, Glycine max
tagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgt

SEQ ID NO: 1959 - DNA, 325 bp, Glycine max
  unsure (1)..(325): unsure at all n locations
tcgatgcacncgtacgtgagctcggaattcggctcgaggcgggtnnctgtctgttcaagctaccatctctctctctctttcttagtgcctccntgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagaggtcacaaccaaggccaacgtggatatganaagattgtgcgtgac

SEQ ID NO: 1960 - DNA, 316 bp, Glycine max
  unsure (1)..(316): unsure at all n locations
gtcgcangcacgcgtacgtaagctcggaattcggctcgaggcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggactn

SEQ ID NO: 1961 - DNA, 495 bp, Glycine max
  unsure (1)..(495): unsure at all n locations
ggnnnnnnnnaatttactctgcccgncaggtacangtacagaattcccggntcgacccacgcgtcagtacggctgcgagaagacgacagaagggggcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaangccaacgttgactacganaagatatgcgtgacacctgcaaggaacatcggcttctctcaaatgatgttgggactggatgccgacaactgcaaggtctcgtcaacatt

SEQ ID NO: 1962 - DNA, 270 bp, Glycine max
  unsure (1)..(270): unsure at all n locations
agtcgcngcacgcgtacgtaaactcggaattcggctcnagcnaggttgataggnatggtgcttacattgtgagacaggctgctaagancattgtggcaagtggacttgccagaaggtgcattgtagcaagtgtcttangccattggtgtgcctgagcctttgtctgtgtttnttgacacctatggcactgggaagatccatgataaggagattctcaacattgngaaggaaaactttgatttcangcctggnatgatctccatcaacctt

SEQ ID NO: 1963 - DNA, 282 bp, Glycine max
  unsure (1)..(282): unsure at all n locations
tgcaccaaaaccaacttggtcatggtcttcggagaaatcacgancaaggccaacgnttgactacggagaagnnatgcgntgaacacctggcaggnccatcggcttcgtctcaaatnangtgggactgccntgccgacaactgcaaggtcctcgtcaacattgagcagcagagccctgatattgctcagggtgtacacggccaccttaccaaaaaacctgaagaaattggtgctggtgaccagggtcacatgtttggcnatgccactgatgaaacccctgact

SEQ ID NO: 1964 - DNA, 306 bp, Glycine max
  unsure (1)..(306): unsure at all n locations
nngttcntgcacgcgtacgtcagctcggaattcggctcgaggcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagntnacaaccaaggccaacgtgg

SEQ ID NO: 1965 - DNA, 317 bp, Glycine max
  unsure (1)..(317): unsure at all n locations
gcangcacgcgtacgtaagctcggaattcggctcgaggacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagancacaaccaaggccaag

SEQ ID NO: 1966 - DNA, 296 bp, Glycine max
  unsure (1)..(296): unsure at all n locations
tcgtangtaagctcggaattcggctcgaggcgggncactgtctgttcaagctaccatctctctctctctttcttagtgcctccttgccagaagttaaaatggcccaagaaactttcctattcacatctgaatcagtgaacgaggggcaccctgacaagctctgtgaccagatctccgacnctgtgctcgatgcatgcttggancaggaccctgacagcaaggttgcctgtgaaacctgcaccaagaccaacatggtgatggttttcggagagatcacaaccaaggccaacgtggat

SEQ ID NO: 1967 - DNA, 318 bp, Glycine max
acgtcgcatgctagcgtacgtaagctcggaattcggctcgagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccacgtggactatg

SEQ ID NO: 1968 - DNA, 313 bp, Glycine max
  unsure (1)..(313): unsure at all n locations
gtcncatgcacgcgtacgtaagctcggaattcggctcgagacagcacaaagcgggttactgtntgttcaagctaccatctctctctctctttcttagtgcctccttgccagaagttaaaatgggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacg

SEQ ID NO: 1969 - DNA, 291 bp, Glycine max
  unsure (1)..(291): unsure at all n locations
ncgtcgcatgcacgcgtacgtaagctcggaattcggctcgagngcagttttaaaagtataaagatggcagagacattcctatttacctacagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacgagaagatagtgcgtgacacctgcaggaa

SEQ ID NO: 1970 - DNA, 327 bp, Glycine max
  unsure (1)..(327): unsure at all n locations
ntgcantnacgcgtacgtaagctcggaattcggctcnagncagacttaacaacagcacaaagcgggttactgtctgttcaagctaccatctctctcncctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcancaagaccaacatggtgatggttttcggagagatcacaaccaaggccaacgtgg

SEQ ID NO: 1971 - DNA, 294 bp, Glycine max
  unsure (1)..(294): unsure at all n locations
tcgcatgcacgcgtacgtaagctcggaattcggctcgagccacaccactctctctgnntcttcttctacctttcaagtntttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccaaggccaacgttgactacgag

SEQ ID NO: 1972 - DNA, 293 bp, Glycine max
  unsure (1)..(293): unsure at all n locations
gtcgcatgcacgcgtacgtaagctcggaattcggctcgagntttcaagtttttaaagtattaagatggcagagacattcctatntacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccaaggccaacgttgnctacgagaagtcgtgcgtgacactgaggaacatcg

SEQ ID NO: 1973 - DNA, 339 bp, Glycine max
  unsure (1)..(339): unsure at all n locations
tcgcngcacgcgtacgtaagctcggaattcggctcgagcgagccatttgggagttaggttctgcacgctctgcttccagcgagtgttctttcttcgnttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctggacagcaaggttgcctgtgagacatgcaccaagaccaacatggtcatggtctttggagagatcacaaccaaggccaacgtagat

SEQ ID NO: 1974 - DNA, 307 bp, Glycine max
  unsure (1)..(307): unsure at all n locations
gtcgcntgcacgcgtacgtaagctcggaattcggctcgaggctacccctttctgctcttcttctacctttcaagttttaaaagtataaagatggcagagacattcctatttacctcagagtcggtgaacgagggacaccctgacaagctctgcgaaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacgagaagatagtgcgtgac

SEQ ID NO: 1975 - DNA, 316 bp, Glycine max
  unsure (1)..(316): unsure at all n locations
anacgcangcangcgtacgtaagctcggaattcggctcgagcaagccccactcaaccaccacaccactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccaaggccaagttgactacgagaagat

SEQ ID NO: 1976 - DNA, 315 bp, Glycine max
  unsure (1)..(315): unsure at all n locations
gtcgcangcacgcgtacgtaagctcggaattcggctcgagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggc

SEQ ID NO: 1977 - DNA, 316 bp, Glycine max
  unsure (1)..(316): unsure at all n locations
gtcgcangcacgcgtacgtaagctcggaattcggctcgaggacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggc

SEQ ID NO: 1978 - DNA, 309 bp, Glycine max
  unsure (1)..(309): unsure at all n locations
nnagangcacgnacaacgtaagctcggaattcggctcgagcaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggc

SEQ ID NO: 1979 - DNA, 298 bp, Glycine max
  unsure (1)..(298): unsure at all n locations
natgnntacgtnagctcggaattcggctcgagcagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggc

SEQ ID NO: 1980 - DNA, 314 bp, Glycine max
  unsure (1)..(314): unsure at all n locations
tcgcangcacgcgtacgtaanctcggaattcggctcgagnttgggagttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggtcatggtctttggagagatcaca

SEQ ID NO: 1981 - DNA, 325 bp, Glycine max
  unsure (1)..(325): unsure at all n locations
gtcgcatgcacgcgtacgtaagctcggaattcgggctcgagcttaacaacagcacaaagcgggttactgtctgttcaagctaccatntctctctctctttcttagtgcctccttgccagaagttaaaatggcccaagnaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggn

SEQ ID NO: 1982 - DNA, 315 bp, Glycine max
  unsure (1)..(315): unsure at all n locations
gtcgcangcacgcgtacgtaagctcggaattcggctcgagnttgggagttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggtcatggtctttggagagatcaca

SEQ ID NO: 1983 - DNA, 298 bp, Glycine max
  unsure (1)..(298): unsure at all n locations
gtcgcatgcacgcgtacgtaagctcggaattcggctcgagcctcagccatgtccttgcaaccaaacttggtgctcgcctcacagaggttaggaagaatggcacctgtgcttggttgaggccagatggtaagacacaagtaaccgtcgagtactacaatgacaatggtgccatggttccagttcgtgtccacactgtcctaatttccacccaacatgatgnncctgtgagcaatgatcaaattgctgcggacttaaaggcatgttataaacctgncatccnggaaaatacttgnaggaa

SEQ ID NO: 1984 - DNA, 299 bp, Glycine max
  unsure (1)..(299): unsure at all n locations
gtcgcangcacgcgtacgtaagctcggaattcggctcgaggcgggttactgtctgttcaagctaccatctctctctctctnnccttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggcc

SEQ ID NO: 1985 - DNA, 306 bp, Glycine max
  unsure (1)..(306): unsure at all n locations
ncgtnncntnnagctcggaattcggctcgagcttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggcc

SEQ ID NO: 1986 - DNA, 300 bp, Glycine max
  unsure (1)..(300): unsure at all n locations
gtcncatgcacgcgtacgtaagctcggnattcggctcgagaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggcc

SEQ ID NO: 1987 - DNA, 319 bp, Glycine max
  unsure (1)..(319): unsure at all n locations
gaaccgtngctggtacgtaagctcggaattcggctcgaggcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggcc

SEQ ID NO: 1988 - DNA, 311 bp, Glycine max
  unsure (1)..(311): unsure at all n locations
gnannngcacgcgtacgtaagctcggaattcggctcgagaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggcc

SEQ ID NO: 1989 - DNA, 331 bp, Glycine max
  unsure (1)..(331): unsure at all n locations
ctngcangcagcgtacgtaagctcggaattcggctcgaggcagacttaacaacagcacaaagcgggttactgtctgttcaagctaccatctctctctctctttcttagtgcctccttgccagaagttaaaatgggcccaaganactttcctnctcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccaacgtggacta

SEQ ID NO: 1990 - DNA, 319 bp, Glycine max
tcaacagtcgcatgcacgcgtacgtaagctcggaattcggctcgagaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggccc

SEQ ID NO: 1991 - DNA, 288 bp, Glycine max
  unsure (1)..(288): unsure at all n locations
ntaangcacgcgtacgtaagctcggaattcggctcgagggacaaatgcaaggtgttggtcaacattgagcaacagagcccggatatcgcccagggtgtgcacggccacttcaccaagcgcccagaggaggttggtgctggtgaccagggtcacatgtcacangtatgccancgatgncacccccgagtacatgcccctcagccatgtccttgcaaccaaacttggtggntcgccncacagaggttaggagaattgcactgtgcttggttgaggccagatggtaagaca

SEQ ID NO: 1992 - DNA, 333 bp, Glycine max
  unsure (1)..(333): unsure at all n locations
nncncngcacgcgtacgtngctcggaattcggctcgagcttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctggcaccaagaccaacatggtgatggttttcggagagatcacaaccaaggccaagtggactatgagaagat

SEQ ID NO: 1993 - DNA, 325 bp, Glycine max
tcgcatgcacgcgtacgtaagctcggaattcggctcgaggttgagaccaagacacactcgttcatatatctctctgctcttctcttctcttctacctctcaagtttttgaagtataaagatggcagagacattcctattcacctcggagtcagtgaacgagggacaccctgataagctctgcgaccaatctccgatgctgtcctcgacgcttgcctcgaacaggacccagacagcaaggttgcctgcgaaacatgcaccaagaccaacttggtcatggtcttcggagagatcaccaccaaggccaacgttgactacgagaagatc

SEQ ID NO: 1994 - DNA, 300 bp, Glycine max
  unsure (1)..(300): unsure at all n locations
acgtcgcatgcacgcgtacgtaagctcggaattcggctcgaggttactgtctgttcaagctaccatctctctctctctttcttagtgcctccttgccagaagtaaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctggcaccaagaccaacatggtgatggttttcggngagatcacaaccaaggccaag

SEQ ID NO: 1995 - DNA, 322 bp, Glycine max
  unsure (1)..(322): unsure at all n locations
gcgtacgtaagctcggaattcggctcgagnaagcnccacttcaaccaccacacnactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaattggtcatggtcttcggagagatcaccaccaaggccaagttgactacgagaagatcgtgcgtgacactgcagg

SEQ ID NO: 1996 - DNA, 321 bp, Glycine max
  unsure (1)..(321): unsure at all n locations
tgggagttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagcgtgcgaccagatctctgatgcagtgctcgatgcgtgccttgaacaggaccctgacagcaaggttgcctgtgagacatgcaccaagaccaacatggtcatggtctttggagagatcacaaccaaggcaacgtagatatgagaagatgtcgtgnacatgcgcgaattgg

SEQ ID NO: 1997 - DNA, 303 bp, Glycine max
  unsure (1)..(303): unsure at all n locations
tcgcangcacgcgtacgtaagctcgggaattcggctcganctcgagccgattcggctcgaggccttttcagggaaggaccctaccacnggttgacagaagtgaccgcctatattgtaaggcagnctgcaaagagtgttcgtgggcaaatggccttgntagaaggtgcattgtgcaagtttcctatgccattggtgtccctgagcccttgtcagtgtttgtggacncttatggaactgggaagattcctgacaaggagattctgcaaattgtgaaggagaatttcgacttcagacctggnatga

SEQ ID NO: 1998 - DNA, 328 bp, Glycine max
  unsure (1)..(328): unsure at all n locations
gtcgcangcacgcgtacgtaagctcggaattcggctcgagncagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacnaccaaggccaacgtggg

SEQ ID NO: 1999 - DNA, 305 bp, Glycine max
  unsure (1)..(305): unsure at all n locations
tcgcanacntacgcncggaatctcggcncganaacagcacaaagcgggttactgtctgttcaagctaccatctctctctctctntcttagtgcctcccttgccagaagttaaaatggcccaagaaactttcctattcacatctgaatcagtgaacgaggggcaccctgacaagctctntgaccagatctccgatgctgtgctcgatgcatgcttggagcaggaccctgacagcaangttgcctgtgaaacctgcaccaagaccaacatggtgatngttttcggagagatcacaaccaaggcnccg

SEQ ID NO: 2000 - DNA, 321 bp, Glycine max
  unsure (1)..(321): unsure at all n locations
gtcgcangcacgcgtacgtaagctcggaattcggctcgagcttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaggccaagtgga

SEQ ID NO: 2001 - DNA, 327 bp, Glycine max
  unsure (1)..(327): unsure at all n locations
gtcgcatgcacgcgtacgtaagctcgggaattcggctcgaggtgatttgggagtttggagcgactgaactaatcattaatttgcactcgctgtttcagcttcatcacccttcttttgcatcatttatatctcttgagaaatggcacaagaaacctttctattcacatctgaatctgtaaacgagggtcaccccgacangctgttcnancagatctctgatgcagtacttgatgcgtgccttgaacaggaccctgacagcaaggttgcctgtgagacatgcaccaagaccaacatggtcatggtcttcggagagatcacaaccaaggc

SEQ ID NO: 2002 - DNA, 316 bp, Glycine max
  unsure (1)..(316): unsure at all n locations
ntcgnatncnagcntangtnagnnttcggntcgagatttgggagttaggttctgcacgctctgcttccagcgagtgttctttcttcgtttcaacaccttaatttgcacacgctgctttcttcngcttgagaaatggnacaagnnacctttctattcacatctgaatctgtaaacgagggtcaccccgacaanctgtgcgaccagatctctgatgcagtgctcgatgcgtgccttgaacaggacnctgacagcaaggttgcctgtgagacatgcaccaagaccaacatggtcatggtctttgganagatcacaacca

SEQ ID NO: 2003 - DNA, 334 bp, Glycine max
  unsure (1)..(334): unsure at all n locations
ccncnngccnacccntngncnncntntcngtcgnngnnncgtacgtnagctcggnattcggctcgngccaagccccactcaaccaccacaccactctctctgctcttcttctacctttcangtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccaaggccaacgttgact

SEQ ID NO: 2004 - DNA, 216 bp, Glycine max
tagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctggcaccaagaccaacatggtgatggttttcggagagatcacaaccaaggcca

SEQ ID NO: 2005 - DNA, 319 bp, Glycine max
  unsure (1)..(319): unsure at all n locations
gnacgacgcangcacgcgtacgtnagctcggaattcggctcgagctcatggtgatgctggtctcactggaagaaagatcatcattgatacctatggtgggtggggtgctcatggtggaggtgccttttcagggaaggaccctaccaaggttgncagaagtggtgcctatatcgtgaggcaggctgcaaagagtgttngtggcaaatggccttgccagaaggtgcattgtccaagtttcctatgccattgggtgtccctgagccctngtcagnggtnggtggacattatggnncntgggaanttcctcacaaggggtttt

SEQ ID NO: 2006 - DNA, 295 bp, Glycine max
  unsure (1)..(295): unsure at all n locations
tcgcatgcacgcgtacgtaagctcggaattcggctcgagctcgagccgctcgagccgattcggctcgaggtggccctcatggtgntgctggtctcactggaccgaaagatacntcattgatacctatggtgggtggggacctcatggtggaggtgccttttcagggaaggaccctaccaaggttgacagaagtggtgcctatatngtgaggcaggctgcaaanagtgttgtggcaaatggccttgccagaaggtgcattgtccaagtttcctatgcnattggtgtccctgagccc

SEQ ID NO: 2007 - DNA, 261 bp, Glycine max
  unsure (1)..(261): unsure at all n locations
tatctctctgttctcttctacctctcaagtttttgaagtatagagatggcagagacattcctatttacctcagagtcagtgaacgagggacaccctgacaagctctgtgaccaaatctctgatgctgtcctcgacgcttgcctcgaacaggacccagacagcaaggttgcctgcgaaacatgcaccaaaaccaacttggtcatggtcttcggagaatcacgaccaaggccaatgtngantacgagaagatatgcgtgaccc

SEQ ID NO: 2008 - DNA, 422 bp, Glycine max
  unsure (1)..(422): unsure at all n locations
caggcaagcnccactcaaccaccacacctctnctngttcacgctacccgctttctgctcttcttctacctttcaagttttaaaagtataaagatggcagagacattcctatttacctcagagtcggtgaacgagggacaccctgacaagctctgcgaccaaatctccgatgctgtcctngacgcttgcctcgagcaggacccanacagcaaagttgcctgcgaaacatgcaccaaaaccaacttggtcatggtcttcggagaaatcacgaccaaggccaacgttgactacgaagaagatagtgcgtgacacctgcaggaaccattngnnttngtctnaaatgatgtggggactggatgcccgacaactggcaaggtcctcgtcnaacattgancatcaaaagccctggtnttggttnagggg

SEQ ID NO: 2009 - DNA, 309 bp, Glycine max
  unsure (1)..(309): unsure at all n locations
tcgcngcacncgtacgtnagctcggnnttcggctcgacctcgagccgaatcggctcgaggggttactgtctgttcaagctaaccatctctctctctctactcntagtgcctccttgccanaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaa

SEQ ID NO: 2010 - DNA, 280 bp, Glycine max
  unsure (1)..(280): unsure at all n locations
ttcaangcagcgtacgtaagctcggaattcggctcgagcggctcgagctcttctacctctcaagtttttgaagtataaagntggcagagacattcctattcacctcggagttagtgaacgagggacaccctgataagctctgcgaccaaatctccgatgctgtcctcgacgcttgcctcgaacaggacccagacagcaaggttgcctgcgaaacatgcaccaagaccancttggtcatggnnttcggagagatcaccaccaaggccaacgttgactacga

SEQ ID NO: 2011 - DNA, 313 bp, Glycine max
  unsure (1)..(313): unsure at all n locations
atgcacgcgtacgtaagctcggaattcggctcgaggcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggtttcgggngngatcanaacaaggg

SEQ ID NO: 2012 - DNA, 290 bp, Glycine max
  unsure (1)..(290): unsure at all n locations
gtcgcangcacgcgtacgtnagctcggaattcggctcgaggcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaa

SEQ ID NO: 2013 - DNA, 274 bp, Glycine max
  unsure (1)..(274): unsure at all n locations
agtcgcanncacgcgtacgtaagctcggaattcggctcganggctcgagcggctcgnggcacggccacctcncaaagaggcctgaggagattggtgctggtnnccaaggtcatatgttcggctatgccactgacgagactnccgagctcatnnccttgagcnatgtccttgccacnaagctccgtgccaagctcaccgaggttcggaagaacgggacatgcccttggctgagacctgatcgcaagacccactccactgttgagtactacaacgn

SEQ ID NO: 2014 - DNA, 299 bp, Glycine max
  unsure (1)..(299): unsure at all n locations
gtcgcangcacgcgtacgtaagctcggaattcggctcgaggcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaacc

SEQ ID NO: 2015 - DNA, 309 bp, Glycine max
  unsure (1)..(309): unsure at all n locations
gcngnagcgtacgtaagctcggaattcggctcgagcttaacaacagcacaaagcgggttactgtctgttcaagctaccatctctctctctctttcttagtgcctcttgccagaagttaaaatgggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggc

SEQ ID NO: 2016 - DNA, 305 bp, Glycine max
  unsure (1)..(305): unsure at all n locations
ttaaagtcnctgcacgcgtacgtaagctcggaattcggctcgagcggctcgangcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaacc

SEQ ID NO: 2017 - DNA, 294 bp, Glycine max
  unsure (1)..(294): unsure at all n locations
gnngcaggcgtacgtaagctcggaattcggctcgaggcacaaagcgggttactgtctgttcaagctaccatctctctctctcttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaacc

SEQ ID NO: 2018 - DNA, 321 bp, Glycine max
  unsure (1)..(321): unsure at all n locations
tcncangcacgcgtacgtaagctcgggaattcgggctcgagggcagacttaacaacagcacaaagcgggttactgtctgttcaagctaccatctctctctctctttcttagtgcctccttgccgcaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggc

SEQ ID NO: 2019 - DNA, 300 bp, Glycine max
  unsure (1)..(300): unsure at all n locations
gtcgcatgcangcgtacgtnagctcggaattcggctcgagcagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaac

SEQ ID NO: 2020 - DNA, 310 bp, Glycine max
  unsure (1)..(310): unsure at all n locations
acccagacgtcgcatgcacgcgtacgtaagctcggaattcggctcganctcgagccgaatcggctcgagtgcagctgacctcaaggagcatgacgatcaagccggtgatacccggagaagtaccttgatgagaagaccattttccacttgaacccctctggccgttttgtcattggaggtcctcacggtgatgctggtctcaccggccgcaagatcatcatcgatacttacggaggatggggtgctcatggtggtggtgccttctccgggaaggatcccaccaagttgataggatggtgcttacatgtga

SEQ ID NO: 2021 - DNA, 326 bp, Glycine max
  unsure (1)..(326): unsure at all n locations
cgcntgcncgcgtacgtaanctcggaattcggctcgagcacacctcncctcgttcacgctacccctttctgctcttcttctacctttcaagtttnaaaagtataangatggcagagacattccnatttacctcagagtcggtgaacgagggacaccctgacaagctctgcgaccaaatctccgatgctgtcctcgacgcttgcctcgagcaggacccagacagcaaagttncctgcgaaacatgcaccaaaaccaacttggncatggtcttcggaganatcacgaccaaggccaacgttgactacgagaaatagtgcgtgacacct

SEQ ID NO: 2022 - DNA, 299 bp, Glycine max
  unsure (1)..(299): unsure at all n locations
gtcgcnngcacgcgtacgtnaagctcggaattcggctcgaggcctcacagaggttaggaagaatggcacctgtgctggttgaggccagatggtaagacacaagtaaccgtcgagtactacaatgacaatggtgccatggttccagttcgtgtccacactgtcctaatttccacccaacatgatgagnctgtgagcaatgatcaaatgctgcggaccttaaagagcatgttatcaagcctgtcatcctgagaagtaccttgatgagaagaccatcttccaccttaaccctctggccgttt

SEQ ID NO: 2023 - DNA, 545 bp, Glycine max
  unsure (1)..(545): unsure at all n locations
aactgtcnnncngcgacgccngtacgtaccagtccactaatncccgggtccacncacgcntccgtacggctgcgaagaagacgacagaagggganacttactagtnntaagcatggagtcctcaantntctntgcttntntcttnancttnaagttttttaaagtattaagatggcaaganacattcctatttacctcaagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcgggagagattaccaccanggccaacgttgactangagaaagatngtgcgtgacacctgcaggaatatcggcttcgtctcaggangatntgggacttgatnctgacatctgcaangtccttgtaaacattncgcagcatanccctaatnttgcccagggtgttgaacggcacnttacnntngnacccgngganntcggtgctgggagg

SEQ ID NO: 2024 - DNA, 271 bp, Glycine max
ccaagccccactcaaccaccacaccactctctctgctcttcttctacctttcaagtttttaaagtattaagatggcagagacattcctatttacctcagagtcagtgaacgagggacaccctgacaagctctgcgaccaaactccgatgctgtcctcgacgcttgccttgaacaggacccagacagcaaggttgcctgcgaaacatgcaccaagaccaacttggtcatggtcttcggagagatcaccaccaaggccaacgttgactacgag

SEQ ID NO: 2025 - DNA, 297 bp, Glycine max
  unsure (1)..(297): unsure at all n locations
gcaagccccactcaaccaccacacctctcctcgttcacgctacccctttctgctcttcttctaacttttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgnaccaaaaccaacttggtcatggtcttcggagaaatcacgaccaaggccaagttgactacgagaagatagt

SEQ ID NO: 2026 - DNA, 310 bp, Glycine max
  unsure (1)..(310): unsure at all n locations
gtcgcangcacgcgtacgtaagctcggaattcggctcgagcttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaacca

SEQ ID NO: 2027 - DNA, 310 bp, Glycine max; identical to SEQ ID NO: 2026
  unsure (1)..(310): unsure at all n locations

SEQ ID NO: 2028 - DNA, 309 bp, Glycine max
  unsure (1)..(309): unsure at all n locations
ngnanccttagagtcgcatgcacgcgtacgtaagctcggaattcggctcgaggttaggttctgcacgctctgcttccagcgagtgttctttcttcgtttcaacaccttaatttgcanacgctgcttcttcngcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggtcatggtctttg

SEQ ID NO: 2029 - DNA, 487 bp, Glycine max
  unsure (1)..(487): unsure at all n locations
aactctacttggncaggccccggtncagaaatcccggctcgacccacgcgtcagtacggctgcgagaagacgacagaagggggcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcangacccagacagcaaagttgcctgcgaaacatgcaccaaaaccaacttggtcatggtcttcggagaaatcacgaacaagggcaacgttgactacgaaaaagataattgcntgacaacctgcagggaacatcggcttcgtctcaaatgatgttgggactggatgccgacaactgcaaaggtctccgtcaaca

SEQ ID NO: 2030 - DNA, 298 bp, Glycine max
  unsure (1)..(298): unsure at all n locations
agtcgcangcacgcgtacgtaagctcggaattcggctcgagccaagccccactcaaccaccacaccactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccaaggcc

SEQ ID NO: 2031 - DNA, 301 bp, Glycine max
  unsure (1)..(301): unsure at all n locations
gttgcangcgtacgtaagctcggaattcggctcgagtttgggagttaggttctgcacgctctgcttccagcgagtgttctnacttcgtttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggtcatggtctttgg

SEQ ID NO: 2032 - DNA, 297 bp, Glycine max
  unsure (1)..(297): unsure at all n locations
cgtcgcangcacgcgtacgtnagctcggnattcggctcgagngcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggngagatcac

SEQ ID NO: 2033 - DNA, 332 bp, Glycine max
  unsure (1)..(332): unsure at all n locations
tgcacgcgtacgtaagctcggaattcggctcgagatttgaggncaggcaagcccnactcaaccaccacacntctcctcgttnangctacccctttctncctcttcttctacctttcaagttttaaaagtataaagatggcagagacattcctatttacctcagagtcggtgaacgagggacaccctgacaagctctgcgaccaaatctccgatgctgtcctcgacgctngcctcgagcaggacccagacagcaaagttgcctgcgaaacatgcaccaaaaccaacttggtcatggtcttcggaganatcacgaccaaggccaacgttgacta

SEQ ID NO: 2034 - DNA, 300 bp, Glycine max
  unsure (1)..(300): unsure at all n locations
tcgcatgcacgcgtacgtnagctcggaattcggctcgagnacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgntcgatgcatgcttggagcaggaccctgacagcaaggttgcctgtgaaacctgcaccaagaccaacatggtgatggttttcggagagatcacaa

SEQ ID NO: 2035 - DNA, 307 bp, Glycine max
  unsure (1)..(307): unsure at all n locations
ncgcangcacgcatacgtnagctcggaattcggctcgagctnaacaacagcacaaagcgggttactgtctgttcaagctaccatcctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtnaaacctgcaccaagaccaacatggtgatggttttcggagagatcacaa

SEQ ID NO: 2036 - DNA, 262 bp, Glycine max
ccaagccccactcaaccaccacaccactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccaaggccaacgt

SEQ ID NO: 2037 - DNA, 323 bp, Glycine max
  unsure (1)..(323): unsure at all n locations
aaatntanangtcgcangcacgcgtacgtaagctcggaattcggctcgagcttaacaacagcacaaagcgggttactgtctgttcaagctaccatctcctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaag

SEQ ID NO: 2038 - DNA, 311 bp, Glycine max
  unsure (1)..(311): unsure at all n locations
gtcgcangcacgcgtacgtaagctcggaattcggctcgaggcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcaca

SEQ ID NO: 2039 - DNA, 301 bp, Glycine max
  unsure (1)..(301): unsure at all n locations
ttcangcacncgtacgtaagctcggaattcggctcgagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggntgcctgtgaaacctgcaccaagaccaacatggtgatggttttcggngagatcacaaccaaggn

SEQ ID NO: 2040 - DNA, 307 bp, Glycine max
  unsure (1)..(307): unsure at all n locations
gtngcangcacgcgtacgtaagctcggaattcggctcgagcagcacaaagcgggttactgtctgttcaagctaccatctctctctctctttcttagtgcctccttgccagaagttaaaatggcccaagaaactttcctattcacatctgaatcagtgaacgaggggcaccctgacaagccctgtgaccagatctccgatgctgtgctcgatgcatgcttggagcaggaccctgacagcaaggttgcctgtgaaacctgcaccaagaccaacatggtgatggttttcggagagatcacaaccaaggcc

SEQ ID NO: 2041 - DNA, 303 bp, Glycine max
  unsure (1)..(303): unsure at all n locations
cgcatgcagtntacgtaagctcggaattcngctcgagcagcacaaagcgggttactgtctgttcaagctaccatctctctctctctttcttagtgcctccttgccagaagttaaaatggctcaagaaactttcctattcacatctgaatcagtgaacgaggaccaccctgacaagctctgtgaccagatctccgatgctgtgctcgatgcatgcttggagcaggaccctgacagcaaggttgcctgtgaaacctgcaccaagaccaacatggtgatggttttcggagagatcacaaccaaggc

SEQ ID NO: 2042 - DNA, 486 bp, Glycine max
  unsure (1)..(486): unsure at all n locations
tngcnaactcttacgcggttcaggtaccggttgnngaattcccggggtcgacccacgcgtcaagtacggctgcgagaagacgacagaagggggcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgttgactacgaagaagatagtgcgtnacacctgcagggaacatccggntnntnccaaaatnangttggancgggatccnanaatttgcnaggggt

SEQ ID NO: 2043 - DNA, 304 bp, Glycine max
  unsure (1)..(304): unsure at all n locations
ngtcgcatgcacgcgtacgtaagctcggaattcggctcgaggggcaccctgnacaagctctgtgaccagatctccgatgctgtgctcgatggcatgcttggagcaggaccctgacagcaaggttgcctgtgaaacctgcaccaagaccaacatggtgatggttttcggagagatcacaaccaaggccaacgtggactatgagcaagcttgtgncgtgacacatgcaggaacattggttttgtctctnatgatgtnggtcttggatgcnnacaactgcaagtctcgtcaacatngagcaacagan

SEQ ID NO: 2044 - DNA, 325 bp, Glycine max
  unsure (1)..(325): unsure at all n locations
gtcgcangcacgcgtacgtaagctcgaattcggctcgaggcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaacctgcaccaagaccaacatggtgatggttttcggagagatcacaaccaggccangtggan

SEQ ID NO: 2045 - DNA, 298 bp, Glycine max
  unsure (1)..(298): unsure at all n locations
gtcgcatgcacgcgtacgtaagctcggaattcggctcgagtgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatggcaccaagaccaacatggtcatggttctttggagagatncacaaccaagggccaacgtagactatgagaagattgttcctgnacacatgccggcgaantggattncannccg

SEQ ID NO: 2046 - DNA, 318 bp, Glycine max
  unsure (1)..(318): unsure at all n locations
gtcgcatgcacncgtacgtaagctcggaattcggctcgaggcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgaggttttcggagagatcacaaccaaggc

SEQ ID NO: 2047 - DNA, 302 bp, Glycine max
  unsure (1)..(302): unsure at all n locations
gngtcgnangcacgcgtacgtnagctcggaatgcggctcgaggggttactgtctgttcaagctaccatctctcnctctctttcttagtgcctccttgccagaagnnaaantngcccaagaaactttcctattcnnatctgaatcagtgaacgaggggcaccctgacaagctctgtgaccagatctccgatgctgtgctcgatgcatgcntggngcaggacnctgacagcaaggttncctgtgaaacntgcaccaagaccaacatggtgatggttttcggagagatcacaaccaaggccaacg

SEQ ID NO: 2048 - DNA, 301 bp, Glycine max
  unsure (1)..(301): unsure at all n locations
tcgnangcacgcgtacgtaagctcggaattcggctcnagtttgggagttaggttctgcacgctctgcttccagcgagtgttctttcttcgtttcaacaccttaatttgcacacgctgcttcttcngcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggtcatggtctt

SEQ ID NO: 2049 - DNA, 273 bp, Glycine max
  unsure (1)..(273): unsure at all n locations
tcgcangcacgcgtacgtaagctcggaattcggctcgagctctctgctcttctcttctcttctacctctcaagtttttgaagtataaagatggcagagacattcctattcacctcggagtcagtgaacgagggacaccctgataagctctgcgaccaaatctccgatgctgtcctcgacgcttgcctcgaacaggacccagacagcaaggttgcctgcgaaacatgcaccaagaccaacttggtcatggtcttcggagagatcaccaccaagg

SEQ ID NO: 2050 - DNA, 313 bp, Glycine max
  unsure (1)..(313): unsure at all n locations
tcgcatgcacgcgtacgtaagctcggaattcggctcgagctgcacgctctgcttccagcgagtgttctttcttcgtttcaacaccttaatttgcanacgctgcttcttctggcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggtcatggtcttggagagatcacaaccagggccaacgt

SEQ ID NO: 2051 - DNA, 312 bp, Glycine max
  unsure (1)..(312): unsure at all n locations
gtcgcangcacgcgtacgtaagctcggaattcggctcgaggacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaanctctgtgaccagatctccgatgctgtgctcgatgcatgcttggagcaggaccctgacagcaaggttgcctgtgaaacctgcaccaagaccaacatggtgatggttttcggagagatcacaacca

SEQ ID NO: 2052 - DNA, 308 bp, Glycine max
  unsure (1)..(308): unsure at all n locations
gcgtacgtaagctcggaattcngctcgaggccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgnctcgagcaggacccagacagcaaagttgcctgcgaaacatgcaccaaaaccaacttggtcatggtcttcggagaaatcacgaccaaggccaacgttgat

SEQ ID NO: 2053 - DNA, 298 bp, Glycine max
  unsure (1)..(298): unsure at all n locations
gtcgcngcacgcgtacgtaagctcggaattcggctcgaggttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgnaccaagaccaacatggtcatggtctttggn

SEQ ID NO: 2054 - DNA, 304 bp, Glycine max
  unsure (1)..(304): unsure at all n locations
nanangangtcgcangcacgcgtacgtnagctcggnattcggctcgaggnaagccccactcaaccaccacaccactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccaccanggc

SEQ ID NO: 2055 - DNA, 481 bp, Glycine max
  unsure (1)..(481): unsure at all n locations
aaactccaccgcccaggtaccggtacaagaattcccggntcgacccacgcgtcnggcgagaagacnacagaagggtacggctgcgagaagacgacagaagggtacggctgcgagaanacgacagaagggtacggctgcgaagaagacgacagaagggtacggctgcgagaagacgacagaagggtacggctgcgagaagacgacagaanggtacggctgcgagaagacgacagaagggggacacttatggaactgggaagattcctgacaaggagattcttcaaattgtgaaggagaatttcgacttcagacctggaatgatcaccattaacttggaccttaagaggggtggccataggttcctcaagacagctgcttatggacactttggaagggatgaccctgacttcacctgggaagttgtgaagccactcaantctgaaaaacctccaacctaagaatggttgtnaatttaancncc

SEQ ID NO: 2056 - DNA, 313 bp, Glycine max
  unsure (1)..(313): unsure at all n locations
nacgtcgcatgcacgcgtacgtaagctcggaattcggctcgagtaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttcgagcaggaccctgacagcaaggttgccntntgaaacctgcaccaagaccaacatggtgatggttttcggagagatcacaaccaa

SEQ ID NO: 2057 - DNA, 306 bp, Glycine max
  unsure (1)..(306): unsure at all n locations
tcncatgcacgcgtacgtaagctcggaattcggctcgaggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgacaccaagaccaacatggtgatggttttcggagagatcacaaccaaggccaacgtggatatg

SEQ ID NO: 2058 - DNA, 325 bp, Glycine max
  unsure (1)..(325): unsure at all n locations
angcacncgtacgtnagctcggnattcggctcgagncanacttaacancagcacaaagcgggttactgtctgttcaagctaccatctctctctctctttcttagtgcctccttgccagaagttaaaatggcccaaganactttcctattcacatctgaatcagtgaacgaggggcaccctgacaagctctgtgaccagatctccgatgctgtgctcgatgcatgcttggagcaggaccctgacagcaaggttgcctgtgaaacctggcaccaagaccaacatggtgatggttttcggagagatcacaaccaaggccaagtggata

SEQ ID NO: 2059 - DNA, 286 bp, Glycine max
  unsure (1)..(286): unsure at all n locations
tcgcatgcacgcgtacgtnagctcggaattcggctcgagctttctgctcttcttctacctttcaagttttaaaagtataaagatggcagagacattcctatttacctcagantcggtgaacgagggacaccctgacaagctctgcgaccaaatctccgatgctgtcctcgacgcttgcctcgagcaggacccagacagcaaagttgcctgcgaaacatgcaccaaaaccaacttggttcatggtcttcggagaaatcacgaccaaggccaacgttgactacgagaa

SEQ ID NO: 2060 - DNA, 280 bp, Glycine max
  unsure (1)..(280): unsure at all n locations
gtcgcangcacgcgtacgtaaagctcggaattcggctcgagnaaagatggcagagacattcctatttacctcagagtcggtgaacgagggacaccctgaccaagctctgcgaccaaatctccgatgctgtcctcgacgcttgcctcgagcaggncccagatagcaaagttncntgcganacatgcaccanaaccnncttggtcatggtcttcggagnnatcacgaccanggcnancgttgactanganangatantgngtgacacctncaggnacatcgg

SEQ ID NO: 2061 - DNA, 324 bp, Glycine max
  unsure (1)..(324): unsure at all n locations
gtcgcatgcacgcgtacgtaagctcggaattcggctcgaggtgatttggagtttggagcgactgaactaatcattaatttgcactcgctgtttcagcttcatcacccttcttttgcatcatttatatctcttgagaaatggcacaagaaacctttctattcacatctgaatctgtaaacgagggtcaccccgacaagctgtgcnaccagatctctgatgcagtacttgatgcgtgccttgancaggaccctgacagcaaggttgcctgtgagacatgcaccnagaccaacaggtcatggtcttcggagagatcacaaccaaggc

SEQ ID NO: 2062 - DNA, 300 bp, Glycine max
  unsure (1)..(300): unsure at all n locations
ganacgtacgtnagctcggaattcggctcgagncttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggtttcggagagatcacaac

SEQ ID NO: 2063 - DNA, 227 bp, Glycine max
  unsure (1)..(227): unsure at all n locations
ntcgcanacacgcgtacgtnagcncggaattcggctcgaggtggcaaatggccttnccagaaggtgcattgtccaagtttcctatgccattggtgtccctgagcccttgtcagtgtttgtggacacttatggaactgggaagattcctgacaaggagattcttcaaattgtgaaggagaatttcgacttcagacctggaatgatcaccattaacttggncttaaann

SEQ ID NO: 2064 - DNA, 313 bp, Glycine max
  unsure (1)..(313): unsure at all n locations
tncntcgaannnangctnacntnagaatgnnnctcganncaagcnccantcaaccancacacntctcctcgttcacgctacccctttctggctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggcc

SEQ ID NO: 2065 - DNA, 311 bp, Glycine max
  unsure (1)..(311): unsure at all n locations
nttgcanncacncgtacgtnagctcggnantcggctcgagncagacttaacaacagcacanagcgggttactntctgttcaagctaccatctctctctctctttcttagtggcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcan

SEQ ID NO: 2066 - DNA, 317 bp, Glycine max
  unsure (1)..(317): unsure at all n locations
cgcatgcataagtacgtaagctcggaattcngctcgagcaagccccactcaaccaccacacctctcctcgttcacgctacccctttctgctcttcttctacctttcaagttttaaaagtataaagatggcagagacattcctatttacctcagagtcggtgaacaagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaacgtt

SEQ ID NO: 2067 - DNA, 306 bp, Glycine max
agtcgcatgcacgcgtacgtaagctcggaattcggctcgagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatca

SEQ ID NO: 2068 - DNA, 320 bp, Glycine max
  unsure (1)..(320): unsure at all n locations
ancagtcgnatgcacgcgtacgtaagctcggaattcggctcgagccccactcaaccaccacacctctcctcgttcacgctacccctttctgctcttcttctacctttcaagttttaaaantataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaagttga

SEQ ID NO: 2069 - DNA, 318 bp, Glycine max
  unsure (1)..(318): unsure at all n locations
nngngcatgcacgcgtacgtnagctcggaattcggctcgagcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaagt

SEQ ID NO: 2070 - DNA, 302 bp, Glycine max
  unsure (1)..(302): unsure at all n locations
ngtcgcangcacgcgtacgtaagctcggaattcggctcgagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagag

SEQ ID NO: 2071 - DNA, 298 bp, Glycine max
  unsure (1)..(298): unsure at all n locations
gnanatgcacgcgtacgtaanctcggaattcggctcgagttgggagttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggtcatggtc

SEQ ID NO: 2072 - DNA, 310 bp, Glycine max
  unsure (1)..(310): unsure at all n locations
cgcangcacgcgtacgtaagctcggaattcggctcgaggcagacttaacaacagcacaaagcgggttactgtctgttcaagctaccatctctctctctctttcttagtgcctcctttcccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacn

SEQ ID NO: 2073 - DNA, 289 bp, Glycine max
agtcgcatgcacgcgtacgtaagctcggaattcggctcgaggggttactgtctgttcaagctaccatctctctctctctttcttagtgcctccttgccagaagttaaaatgggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcaca

SEQ ID NO: 2074 - DNA, 309 bp, Glycine max
  unsure (1)..(309): unsure at all n locations
tcgcangnangcgtacgtaagctcggaattcggctcgagncagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcac

SEQ ID NO: 2075 - DNA, 308 bp, Glycine max
  unsure (1)..(308): unsure at all n locations
gtcncngcacgcgtacgtaagctcggaattcggctcgagcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcac

SEQ ID NO: 2076 - DNA, 310 bp, Glycine max
  unsure (1)..(310): unsure at all n locations
gtcgcatgcacgcgtacgtnagctcgganttcggctcgagcttaacaacagcacaaagcgggttactgtctgttcaagctaccntctctctctctctttcttngtgcctccttgccagaagttaaaatggcccaaganactttcctattcacntctgantcngtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatcacaacca

SEQ ID NO: 2077 - DNA, 310 bp, Glycine max
  unsure (1)..(310): unsure at all n locations
cnnatgcacgcgtacgtaagctcggctcgagccgaatcggctcgaggttgagaccaagacacactcgttcatatatctctctgctcttctcttactcttctacctctcaagtttttgaagtataaagatggcagagacattcctattcacctcggagtcagtgaacgagggacaccctgataagctctgcgaccaaatctccgatgctgtcctcgacgcttgcctcgaacaggacccagacagcaaggttgcctgcgaaacatgcaccaagaccaacttggtcatggtcttcggagagatcaccaccaag

SEQ ID NO: 2078 - DNA, 325 bp, Glycine max
  unsure (1)..(325): unsure at all n locations
cagtcgcangcacgcgtacgtaagctcgtgaattcggctcgagcagacttaacaacagcacaaagcgggtnactgtctgttcaagctaccatntctctntctctttcttagtggctccttgccanaagttaaaatggcccaagaaactttcctatncacatctgaatcagtnaacgangggcaccctgacaagctctgtgaccagatctccgatgctgtgctcgatgcatgctgggagcaggaccctgncagcaaggttgcctgtgaaacctgcaccaagaccaacatggtgatggttttcggagagatcacaaccaaggnnagc

SEQ ID NO: 2079 - DNA, 249 bp, Glycine max
  unsure (1)..(249): unsure at all n locations
ctcgagccgctcgagccgattcggctcgagctcccgagctcatncccttgagccatgtcactgccacgacgctcggtgccaagctcaccgaggttaggnagaacgggacatgcccttggctgagacctgatggcaagacccaagtcactgttgagtactacaatgacaagggtgccatggttccaatccgcgtccacactgtgctcatctccacacagcatgatganctgtcacaaatgatgagattgc

SEQ ID NO: 2080 - DNA, 325 bp, Glycine max
  unsure (1)..(325): unsure at all n locations
annnncgtgtacgtnagctnngacatcggnattcggctcgagncagacttnacaacagcacaaagcgggttactgtctgttcaagctaccatctctctctctctttcttagtgcctccttgccagangttnaaatgggcncaagaaactttcctattcacatctgnatcagtgaacgaggggcaccctgacaagctctgtgaccagatctccgatgctgtgctcgatgcatgcttggagcaggaccctgacagcaaggttgcctgtgaaacctggcaccaagaccaacatggtgatggttttcggagagatcacaaccaaggcca

SEQ ID NO: 2081 - DNA, 316 bp, Glycine max
  unsure (1)..(316): unsure at all n locations
nnangcacgcgtacgtaagctcggaattcggctcgagcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacagctctgtgaccagatctccgatgctgtgctcgatgcatgcttggagcaggaccctgacagcaaggttgcctgtgaaacctgcaccaagaccaacatggtgatggttttcggagagatcacaaccaaggcca

SEQ ID NO: 2082 - DNA, 303 bp, Glycine max
  unsure (1)..(303): unsure at all n locations
ncgtcgcatgcacgcgtacgtaagctcgggatttcggctcgaggggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcnaccaagaccaacatggtgatggttttcggagagatcacaaccaangccaac

SEQ ID NO: 2083 - DNA, 333 bp, Glycine max
gtcgcatgcacgcgtacgtaagctcggaattcggctcgagaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaattggtcatggtcttcggagaaatcacgaccaaggccaagttgactacgagaagatatg

SEQ ID NO: 2084 - DNA, 287 bp, Glycine max
gcacgcgtacgtaagctcggaattcggctcgaggtgccttctctgggaaggatcctaccaaggttgataggagtggtgcctacattgtgaggcaagctgcaaagagcattgttgcaaatggacttgctaggagggcaattgtgcaagtttcctatgccattggtgtgcctgagccctgtctgtgtttgttgacacttatggcactgggaagatcccgacaaggaaatcctcagcatgtgaaggagagttttgactcagccggcagatctccatcaacctgatctcaa

SEQ ID NO: 2085 - DNA, 281 bp, Glycine max
cgtacgtaagctcggaattcggctcgagcagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagaga

SEQ ID NO: 2086 - DNA, 294 bp, Glycine max
gcacgcgtacgtaagctcgggaattcggctcgaggcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcg

SEQ ID NO: 2087 - DNA, 294 bp, Glycine max
  unsure (1)..(294): unsure at all n locations
gtcgcangcacgcgtacgtaagctcggaattcggctcgagttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcg

SEQ ID NO: 2088 - DNA, 290 bp, Glycine max
  unsure (1)..(290): unsure at all n locations
nngtcgcangcacgcgtacgtaagctcggaattcggctcgagacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcg

SEQ ID NO: 2089 - DNA, 322 bp, Glycine max
  unsure (1)..(322): unsure at all n locations
agtcgcangcangcgtacgtnagctcggaattcggctcgaggcagacttaacaacagcacaaagcgggttactgtctgttcaagctaccatctctcnctctctttcttagtgcctccttgccagaagttaaaatggcccaagaaactttcctattcacatctgaatcagtgnacgaggggcaccctgacaagctctgtgaccagatctccgatgctgtgctcgatgcatgctcggagcaggaccctgacagcaaggttgcctgtgaaacctgcaccaagnccaacntggtgatggttttcggagannncaanccaagggcan

SEQ ID NO: 2090 - DNA, 318 bp, Glycine max
  unsure (1)..(318): unsure at all n locations
tcgcangcacgcgtacgtaagctcggaattcggctcgagnggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccanaaccaacttggtcatggtcttcggagaaatcacgaccaagg

SEQ ID NO: 2091 - DNA, 301 bp, Glycine max
  unsure (1)..(301): unsure at all n locations
tcgcangcacgcgtacgtnagctcggaattcggctcgagcttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagat

SEQ ID NO: 2092 - DNA, 289 bp, Glycine max
  unsure (1)..(289): unsure at all n locations
gtcgcatgcacgcgtacgtnagctcggaattcggctcgagccaagccccactcaaccaccacacnactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcacca

SEQ ID NO: 2093 - DNA, 309 bp, Glycine max
  unsure (1)..(309): unsure at all n locations
gtcgcatgcacgcgtacgtaagctcggaattcngctcgaggccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccanaaccaacttggtcatggtcttcggagaaatcacgaccaaggc

SEQ ID NO: 2094 - DNA, 336 bp, Glycine max
  unsure (1)..(336): unsure at all n locations
tcgcangcacgcgtacgtaagctcggaattcggctcgaggggccaggcaagccccactcaaccaccacacctncgcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccanaaccaacttggtcatggtcttcggagaaatcacgaccaaggccaagttgactacgaga

SEQ ID NO: 2095 - DNA, 202 bp, Glycine max
tagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatc

SEQ ID NO: 2096 - DNA, 315 bp, Glycine max
  unsure (1)..(315): unsure at all n locations
gtcgcangcacgcgtacgtaagctcggaattcggctcgagctcgagccggaacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagagatc

SEQ ID NO: 2097 - DNA, 322 bp, Glycine max
  unsure (1)..(322): unsure at all n locations
cnaagagtcgcatgcacgcgtacgtaagctcggaattcngctcganggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccannaccaacttggtcatggtcttcggagaaatcacgaccaaggcca

SEQ ID NO: 2098 - DNA, 307 bp, Glycine max
  unsure (1)..(307): unsure at all n locations
nnnttcnngcactcgtacgnaagctcggaattcggctcgaggaccaagccccactcaaccaccacaccactctntctggctcttcttctacctttcaagttnttaaagtattaagatggcngagacagccctatttaccncagagtcagtgaacganggacaccctgacaagctctgcgaccaaatctccgatgctgtcctcgacgcttgccttgaacaggacccagacagcaaggttgcctgcgaaacatgcaccaagaccaacttggtcatggtctncggagagatcaccaccaaggccaacgtt

SEQ ID NO: 2099 - DNA, 323 bp, Glycine max
  unsure (1)..(323): unsure at all n locations
tatgcntncacgcgtacgtaagctcgagaattcggctcgagaggccaggcaagccccactcaaccaccacacctctnctcgttcacgctaccccttaatgctcttctnctacctttnaagttttaaaagtataaagatggcagagacattcctatttacctcagagtcggtgaacgagggacaccctgacaagctctgcgaccaaatctccgatgctgtcctcgacgcttgcctcgagcncgacccagacagcaaagttgcctgcgaaacatgcaccaanaccaacttggtcatggtcttcggagaaatcacgaccaaggcca

SEQ ID NO: 2100 - DNA, 289 bp, Glycine max
  unsure (1)..(289): unsure at all n locations
gcnngcacgcgtacgtaagctcggaattcggctcgaggttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggtcatggt

SEQ ID NO: 2101 - DNA, 290 bp, Glycine max
  unsure (1)..(290): unsure at all n locations
gtcgcangcacgcgtacgtaagctcggaattcggctcgagccaagccccactcaaccaccacacnactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcaccac

SEQ ID NO: 2102 - DNA, 301 bp, Glycine max
  unsure (1)..(301): unsure at all n locations
ggtngtaaggtcggaattcggctcgagnaccgatgaaacccccgagtacatgcccctcagccatgtccttgcaaccaaacttggtgctcgcntcacagaggttaggaagaatggnacctgtgcttggttgaggccagatggtaagaccaagtaaccgtngagtactacaatgacaatggtgccatggttccagttcgtgtccacactgtnctaatttccacacaacanaaaanncttanaaannaatgatcatattgctgcggacttaaagagcagttattnaagcctgtgnatctgagaa

SEQ ID NO: 2103 - DNA, 311 bp, Glycine max
  unsure (1)..(311): unsure at all n locations
acgtcgcatgcacgcgtacgtaagctcggaattcggctcgagcaagccccactcaaccaccacaccactctctctgctcttcttctacctttcaagtttttaaagtattaagntggcagagacattcctatttacctcagagtcagtgaacgagggacaccctgacaagctctgcgacaaatctccgatgctgtcctcgacgcttgccttgaacangacccagacagcaaggttgcctgcgaaacatgcaccaagaccaacttggtcatggtcttcggagagatcaccaccaaggccaagttgactagaga

SEQ ID NO: 2104 - DNA, 313 bp, Glycine max
  unsure (1)..(313): unsure at all n locations
gnacangcacgcgtacgtaagctcggaattcggctcgaggcagacttaacaacagcacaaagcgggttactgtctgttcaagctaccatctctctctctctttcttagtgcctccttgccagaagttaaaatggcccaagaaactttcctattcacatctgaatcagtgaacgaggggcacctgacaagctctgtgaccagatctccgatgctgtgctcgatgcatgcttggagcaggaccctgacagcaaggttgcctgtgaaacctgcaccaagaccaacatggtgatggttttcggagagatcacaacca

SEQ ID NO: 2105 - DNA, 306 bp, Glycine max
  unsure (1)..(306): unsure at all n locations
ttncngcacgcgtacgtaagctcggaattcggctcgagntaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctggcaccaagaccaacatggtgatggttttcggagagatcacaac

SEQ ID NO: 2106 - DNA, 325 bp, Glycine max
  unsure (1)..(325): unsure at all n locations
agttcanacagcgtacganagctcggaantcggctcgagggccaggcnagcccnatcaaccancacacntctcctacnctcacgctacnccttgctgcncttcncgcgacnttngcaagtnctnaaaagtataaagatggcagagacatncctantnaccncagagtcggtgaacgaggganaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaaggccaac

SEQ ID NO: 2107 - DNA, 294 bp, Glycine max
  unsure (1)..(294): unsure at all n locations
aanngangcacgcgtacgtaagctcggaattcggctcgagcaacagcacaaagcnggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggaga

SEQ ID NO: 2108 - DNA, 304 bp, Glycine max
  unsure (1)..(304): unsure at all n locations
gtcgcatgcacgcgtacgtaagctcggaattcggctcgagctcgagccgcaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggagan

SEQ ID NO: 2109 - DNA, 303 bp, Glycine max
  unsure (1)..(303): unsure at all n locations
agtcgcangcacgcgtacgtaagctcggaattcggctcgagagacttaacaacagcacaaagcgggttactgtctgttcaagctacnatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggaga

SEQ ID NO: 2110 - DNA, 303 bp, Glycine max
  unsure (1)..(303): unsure at all n locations
ngtngcatgcacgcgtacgtaagctcggaattcggctcgagcgagccatttgggagttaggttctgcacgctctgcttccagcgagtgttctttcttcgtttcaacaccttaatttgcacacgctgcttcttcagcttgagaantggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggtca

SEQ ID NO: 2111 - DNA, 298 bp, Glycine max
  unsure (1)..(298): unsure at all n locations
acgtcgcatgcacgcgtacgtaagctcggaattcggctcgagatttgggagttaggttctgcacgctctgcttccagcgagtgttctttcttcgtttcaacaccttaatttgcatacgctgcttcttcngcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggtca

SEQ ID NO: 2112 - DNA, 286 bp, Glycine max
  unsure (1)..(286): unsure at all n locations
nncgcangcacgcgtacgtaagctcggaattcggctcgagagccccactcaaccaccacaccactctctctgctcttcttctacctttcaagtttttaaagtattaagatggcagagacattcctatttacctcagagtcagtgaacgagggacaccctgacaagctctgcgaccaaatctccgatgctgtnntcgacgcttgccttgaacaggacccagacagcaaggttgcctgcgaaacatgcaccaagaccaacttggtcatggtcttcggagagatcacca

SEQ ID NO: 2113 - DNA, 316 bp, Glycine max
  unsure (1)..(316): unsure at all n locations
cacgtcgcangcacgcgtacgtaagctcggaattcggctcgagtgacaaggagattctgcaaattgtgaaggagaatttcgacttcagacctggaatgatcaccattaacttggaccttaagaggggtggtcataggttcctcaagacagctgcttatggacactttggaagggatgatgcagacttcacctgggaagttgtgaagccactcaagtcagagaagcctcaagcttaagagtgttgttaagttaatcactcccttcagtggatgtcttgctgggtgtggatgaataatttgcgtgtttcatgactact

SEQ ID NO: 2114 - DNA, 308 bp, Glycine max
  unsure (1)..(308): unsure at all n locations
tgcangcacgcgtacgtaagctcggaattcggctcgagntatcaagcctgtcattcctgagaagtaccttgatgacatgctctttaaggtccgcagcaatttgatcattgctcacagtctncatcatgttgggtggaccttaaagagcannttntcaagcctgtcattcctgagaagtaccttgatgagaagaccatcttccaccttaacccttctggccgttttgtcattggtggccctcatggtgangctgcnctcactggaagaaagatcatcattgatacctatggtggctggggtgctcatgg

SEQ ID NO: 2115 - DNA, 284 bp, Glycine max
  unsure (1)..(284): unsure at all n locations
ctngcnctngtacgtnagctcggaattcggctcgaggnaccaagccccactcaaccaccacacnactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatc

SEQ ID NO: 2116 - DNA, 283 bp, Glycine max
  unsure (1)..(283): unsure at all n locations
cgcangcacgcgtacgtaagctcggaattcggctcgagccaagccccactcaaccaccacaccactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatc

SEQ ID NO: 2117 - DNA, 298 bp, Glycine max
  unsure (1)..(298): unsure at all n locations
ngtcgcatgcacgcgtacgtaagctcggaattcggctcgaggacttaacaacagcacaaagcgggttactgtctgttcaagctaccatctctctctctctttcttagtgcctccttgccagaancgcaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttc

SEQ ID NO: 2118 - DNA, 288 bp, Glycine max
  unsure (1)..(288): unsure at all n locations
annnaancaagcgtacgtaagctcggaattcggctcgaggttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggtcat

SEQ ID NO: 2119 - DNA, 329 bp, Glycine max
  unsure (1)..(329): unsure at all n locations
tgcangcacgcgtacgtaagctcggaattcnnctcgaggcannacnccantncaaccaccacacctctcntcgttcangctannnaaatnctgctgttcttctacctgtcaagttttgaaagtatanagatggcaganacattcctatttacctcanagtcggtgaacgagggacaccctgacaagctctgcgaccaaatctccgntgctgtcctcgacgcttgcntcgagcagnacccagacagcaaagttgccngcganacatggaccaaaaccaacttggtcatggtnttcggagaaatcacgaccaaggccaacgttgactacnn

SEQ ID NO: 2120 - DNA, 277 bp, Glycine max
  unsure (1)..(277): unsure at all n locations
ggccaggcaagccccactcaaccaccacacctctcctcgttcacgctacccctttctgctcttcttctacctttcaagttttaaaagtataaagatggcagagacattcctatttncctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaag

SEQ ID NO: 2121 - DNA, 286 bp, Glycine max
  unsure (1)..(286): unsure at all n locations
cgcangcacgcgtacgtaagctcggaattcggctcgagcaagccccactcaaccaccacacgcgtcnctctngcgcttcttctacctttcaagtttttaaagtattaagatggcaganacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttcggagagatcacc

SEQ ID NO: 2122 - DNA, 339 bp, Glycine max
  unsure (1)..(339): unsure at all n locations
annctgaancgtangnaagcntacgnattcngctcgagnggcaggcaagccccactcaancaccacacctgctcctgcgtncangctnacccgtnnngangnnatgactacctntcaagttntaaaagtatngnanatggcngagacattcctatttacctcagagtcggtgaacgagggacaccctgacaagctctgcgaccaaatctccgntgctgtcctcgacgcttgcctcgagcaggacccagacagcaaagttgcctgcgaaacatgcaccaccaccaagttggtcatggtcttcggagaaatcacgaccaaggcnaacgttactacgagann

SEQ ID NO: 2123 - DNA, 480 bp, Glycine max
  unsure (1)..(480): unsure at all n locations
anctcttaccggctntntngcccaaaatngtanangcttcccggctcgacncacgcgtcngtacggctgcgagaagacgacagaagggggcagctcttgatttnaggncangcaanccccactcaancaccacacctctcctcgttcacgctatccctttctgctcttcttctacctttcangttttaanagtacncacatggcaagacacattcctatttanctnagactcggtgaannacggacaccctgacaagctctgcgaccaaatctccgatnctgtcctcgacgcttgcctcgancaggactcagacancananttgcctgcnaaacatgcaccaaaaccaacttggtcatggtcttcngagaantcacgaccaaggccaacnttgactacgaaaaganngtgcgttacacctgccgggaacatcggcttctttcnaaatgatgttgggactggatgccgaccactgcatngg

SEQ ID NO: 2124 - DNA, 307 bp, Glycine max
  unsure (1)..(307): unsure at all n locations
anntcgcangcacgcgtacgtnagctcggaattcggctcgagccttaacaacagcacaaagcgggttactgtctgttcaagctaccatctctctctctactttcttagtgcctccttgccagangttaaaatggcccaagaaactttcctattcacatctgaatcagtgaacgaggggcaccctgacaagctctgtgaccagatctccgatgctgtgctcgatgcatgcttggagcagganncctgacagcaaggttgcctgtgaaacctgcaccaagaccaacatggtgatggttttcggagagat

SEQ ID NO: 2125 - DNA, 307 bp, Glycine max
  unsure (1)..(307): unsure at all n locations
tcgnngacgcgtacgtaagctcggaattcggctcgaggacttaacaacagcacaaagcgggttactgtctgttcaagctaccatctctctctcncntttcctnagtgcctccttgccagaagttaaaatggcccaagaaactttcctattcacatctgaatcagtgaacgaggggcaccctgaaagctctgtgaccagatctccgatgctgtgctcgatgcatgcttggagcaggaccctgacagcaaggttgcctgtgaaacctgcaccaagaccaacatggtgatggttttcggagagatcacaa

SEQ ID NO: 2126 - DNA, 309 bp, Glycine max
  unsure (1)..(309): unsure at all n locations
ttcgcatgcacgcgtacgtaagctcggaattcggctcgagcaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtnaccagatctccgatgctgtgctcgatgcatgcttggagcaggaccctgacagcaaggttgcctgtgnaaacctggcaccaagaccaacatggtgatggttttcggagagatcacaaccaag

SEQ ID NO: 2127 - DNA, 302 bp, Glycine max
  unsure (1)..(302): unsure at all n locations
aaaanntnaanagcgtacgtaagctcggaattcggctcgagnagacacactcgttcatatatctctctgctcttctcttctcttctacctctcaagtttttgaagtataaagatggnagagacattcctattcacctcggagtcagtgaacgagggacaccctgataagctctgcgaccaaatctccgatgctgtcctcgacgcttgcctcgaacaggacccaganagcaaggttgcctgcgaaacatgcaccaagaccaattggtcatggtcttcggagagatcaccaccaaggccaacgt

SEQ ID NO: 2128 - DNA, 288 bp, Glycine max
  unsure (1)..(288): unsure at all n locations
gtcgcangcacgcgtacgtnagctcggaattcggctcgagcacanagcgggttactgtctgttcaagctaccatctctactctctctttcttagtgcctccttgccagaagttanaatggcccaagaaactttcctattcacgtctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggag

SEQ ID NO: 2129 - DNA, 279 bp, Glycine max
  unsure (1)..(279): unsure at all n locations
gtcgcangcacgcgtacgtaagctcggaattcggctcgagcacactcgttcatatatctctctgctcttctcttctcttctacctctcaagtttttgaagtataaagatggcagagacattcctattcacctcggagtcagtgaacgagggacaccctgataagctctgcgaccaaatctccgatgctgtcctcgacgcttgcctcgaacaggacccagacagcaaggttgcctgcgaaacatgcaccaagaccaacttggtcatggtcttcggagaga

SEQ ID NO: 2130 - DNA, 301 bp, Glycine max
  unsure (1)..(301): unsure at all n locations
cgtcgcntgcacgcgtacgtaagctcgggaattcggctcgagcgagccatttgggagttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatgg

SEQ ID NO: 2131 - DNA, 299 bp, Glycine max
  unsure (1)..(299): unsure at all n locations
gtcgcangcacgcgtacgtaagctcggaattcggctcgaggcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttn

SEQ ID NO: 2132 - DNA, 299 bp, Glycine max
gtcgcatgcacgcgtacgtaagctcggaattcggctcgaggcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttc

SEQ ID NO: 2133 - DNA, 320 bp, Glycine max
  unsure (1)..(320): unsure at all n locations
gtcgnacacaaagcgtagtnaagctcggaattcggctcgagcggagattcttcaaattgtgaaggagaatttcgacttcagacctggaatgatcaccattaacttggaccttaagaggggtggccataggttcctcaagacagctgcttatggacactttggaagggatgaccctgacttcacctgggaagttgtgaagccactcaagtctgagaagcctcaagcttaagattgttgtgaagttaatcactcccttcaatggatgtcttgctaggtgtggatgaataatttgcgtgttccatgactactactacttcatc

SEQ ID NO: 2134 - DNA, 313 bp, Glycine max
  unsure (1)..(313): unsure at all n locations
nnaatnntaangcacgcntacgtaagctcggaattcggctcgaggggagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaatntgcaccaaaaccaacttggtcatggtcttcggagaaatcacgacca

SEQ ID NO: 2135 - DNA, 316 bp, Glycine max
  unsure (1)..(316): unsure at all n locations
angnatcgcangcncgcgtacgtnagctcggaattcggctcgagggccaggcaagccccactcaaccaccacacctctcctcgttcncgctacccctttctgctcttcttctacctttcangttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacga

SEQ ID NO: 2136 - DNA, 309 bp, Glycine max
  unsure (1)..(309): unsure at all n locations
agtcgcangcacgcgtacgtaagctcggaattcngctcgaggcaagccccactcaaccaccacacctctcctcgttcacgctacccctttctngctcttcttctacctttccaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacga

SEQ ID NO: 2137 - DNA, 280 bp, Glycine max
  unsure (1)..(280): unsure at all n locations
cgcangcacgcgtacgtaagctcggaattcggctcgagcacaaagcgggttactgtctgttcaagctaccatctctctctctctttcttagtgcctccttgccagaagttaaaatggcccaagaaactttcctattcacatctgaatcagtgaacgaggggcacccngacaagctctgtgaccagatctccgatgctgtgctcgatgcatgcttggagcaggaccctgacagcaaggttgcctgtgaaacctgcaccaagaccaacatggtgatggtttt

SEQ ID NO: 2138 - DNA, 303 bp, Glycine max
  unsure (1)..(303): unsure at all n locations
gtcgcangcacgcgtacgtaagctcggaattcggctcgagcggctcgagatttgggagttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggt

SEQ ID NO: 2139 - DNA, 293 bp, Glycine max
  unsure (1)..(293): unsure at all n locations
gtcgnatgcacgcgtacgtaagctcggaattcggctcgagtttgggagttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggt

SEQ ID NO: 2140 - DNA, 325 bp, Glycine max
  unsure (1)..(325): unsure at all n locations
antcncngcacgcgtacgtaagctcggaattcggctcgagtgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagtngcctgcgaaanatgcaccagaaccaacttggtcatggtcttcggagaaatcacgaccaag

SEQ ID NO: 2141 - DNA, 298 bp, Glycine max
  unsure (1)..(298): unsure at all n locations
ntcgcangcacgcgtacgtaagctcggaattcggctcgagctgacaaggagattcttcaaattgtgaaggagaattncgacttcanacctggaatgatcaccattaacttggaccttaagaggggtggccataggttcctcaagacagctgcttatggacactttggaagggatgaccctgacttcacctgggaagttgtgaagccactcaagtctgagaagcctcaagcttaagattgttgtgaagttaatcactcccttcaatggatgtcttgctaggtgtggatgaataatttgc

SEQ ID NO: 2142 - DNA, 301 bp, Glycine max
  unsure (1)..(301): unsure at all n locations
cgctnnacgtcgcangcacgcgtacgtaanctcggaattcggctcgagnttgggagttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatggt

SEQ ID NO: 2143 - DNA, 283 bp, Glycine max
  unsure (1)..(283): unsure at all n locations
gcgtacgtaagctcggaattcggctcgagcaacagcacaaagcgggttactgtctgttcaagctaccatctctctctctctttcttagtgcctccttgccagaagttaaaatggcccaagaaactttcctattcacatctgaatnagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggaga

SEQ ID NO: 2144 - DNA, 293 bp, Glycine max
  unsure (1)..(293): unsure at all n locations
ncgtcgcatgcacgcgtacgtaagctcggaattcggctcgagcaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcgg

SEQ ID NO: 2145 - DNA, 294 bp, Glycine max
  unsure (1)..(294): unsure at all n locations
gtcgcangcacgcgtacgtaagctcggaattcggctcgagcttaacaacagcacaaagcgggttactgtctgttcaagctaccatctctctctctctttcttagtgcctccttgccagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcgga

SEQ ID NO: 2146 - DNA, 291 bp, Glycine max
  unsure (1)..(291): unsure at all n locations
gtcgcangcacgcgtacgtaagctcggaattcggctcgagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggt

SEQ ID NO: 2147 - DNA, 340 bp, Glycine max
  unsure (1)..(340): unsure at all n locations
acgcgtacgtaagctcggaattcggctcgagggccaggcaagccccactcaaccaccacacntctcctgcgttcangctacccctttctngctcttcttctacctntcaagtnttaaaagtataaagatggcagagacattcctatttacctcagagtcggtgaacgagggacaccctgncaagctctgcgaccaaatctccgatgctgtcctcgacgcttgcctcgagcaggacccagacagcaaagttgcctggcgaaacatgcaccantnnnacttggtcatggtcttcggagaaatcacgaccaaggccaacgttgactacgagaagatagtgcgt

SEQ ID NO: 2148 - DNA, 319 bp, Glycine max
  unsure (1)..(319): unsure at all n locations
agnanctgcacgcgtacgtaagctcggaattcggctcgagatttgaggncaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgac

SEQ ID NO: 2149 - DNA, 198 bp, Glycine max
  unsure (1)..(198): unsure at all n locations
tagtgcctccttgccagaagttaaaatggcccaaganactttcctattcanatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatggttttcggaga

SEQ ID NO: 2150 - DNA, 293 bp, Glycine max
  unsure (1)..(293): unsure at all n locations
ngtcncangcacgcgtacgtnagctcggaattcggctcgaggcacaaagngggttactgtctgttcaagctaccatctctctctctgctttgcttagtgcctccttgccagaagttaaaatggcccaagaaactttcctattcacatctgaatcagtgaacgaggggcaccctgacaagctctgtgaccagatctccgatgctgtgctcnngccatgcttggagcaggaccctgacagcaaggttgcntgtgaaacctgcaccaagaccaacatggtgatggttttcggagag

SEQ ID NO: 2151 - DNA, 295 bp, Glycine max
  unsure (1)..(295): unsure at all n locations
agttgcatgcactcgtacgtaagctcggaattcggctcgaggtcttcggagaaatcacgaccaaggccaacgttgactacgagaagatagtgcgtgacacctgcaggaacatgcggcttccgtctcaaatgatgtgggactggatgccgacaactgcaaggtcctcgtcaacattgagcagcagagccntgatattgcctcagggtgtacacggnccaccttacnnnnaaacctgaagaanttggtgctggtgaccagggtccacatgtttggctatgccatgatgaaaccccnc

SEQ ID NO: 2152 - DNA, 219 bp, Glycine max
  unsure (1)..(219): unsure at all n locations
tagtgcctcctcgccagaagttaaaatggcccaagaaactttcctattcacatctgaatcagtgaacgaggggcaccctgacaagtctgtgaccagatctccgatgctgtgctcgatgcatgcttggagcaggaccctgacagcaaggttgcctgtgaaacctggcaccaagaccaacatggtgatggttttcggagagatcacaancaaggccaacgt

SEQ ID NO: 2153 - DNA, 218 bp, Glycine max
  unsure (1)..(218): unsure at all n locations
tantgcctccttgtcagaagttaaaatggcccaagaaactttcctattcacatctgaatcagtgaacgaggggcaccatcgacaagctctgtgaccagatctccgatgctgtgctcgatgcatgcttggagcaggaccctgacagcaaggttgcctgtgaaacctgcaccaagnaccaacatggtgatggttttcggagagatcacaaccaaggccaa

SEQ ID NO: 2154 - DNA, 291 bp, Glycine max
  unsure (1)..(291): unsure at all n locations
cangcgtacgtaagctcggaattcggctcgagacagcacaaagcgggttactgtctgtncaagcnaccatctcnctctctctttcttagtgcctccttgccagaagttaaaatggcccaagaaactttcctattcacatctgaatcagtgaacgaggggcaccctgacaagctctgtgaccagatctccgatggctgtnctcgatgcatgcttggagcaggaccctgacagcnaggttgcctgtgaaacctgcaccaagaccaacatggtgatggttttcggagagatcan

SEQ ID NO: 2155 - DNA, 309 bp, Glycine max
  unsure (1)..(309): unsure at all n locations
tncngtnnnnngcacgcgtacgtaagctcggaattcggctcgagnacttaanaanagcacaaagcgggttactgtctgttcaagctancatctctctctctctttcttagtgcctccttgccagaagttaaaatgggcccaagaaactttcctattcacatntgaatcagtgaacgaggggcaccctgacaagctctgtgaccagatctccgatgctgtgcttcgatgcatgcttggagcaggaccctgacagcaaggttgcctgtgaaacctgcaccaagaccaacatggtgatggttttcggagaga

SEQ ID NO: 2156 - DNA, 313 bp, Glycine max
  unsure (1)..(313): unsure at all n locations
nantcgcatncacgcgtacgtaagctcgagaatggccacncacgccccactcaaccactanacntntcctcnttcacgctacccctttctgctctncttntacntttcaagttttaaaannataaagatggcagagacattcctatttanctcagagtcggtgaacgagggacaccctgacaagctctgcgaccaaatctccgatgctgtcctcgacgcttgcctcgagcaggacccagacagcaaagttgcctgcganacatgccaccaaaaccaacttggtcatggtcttcggagaaatcacgaccaaggc

SEQ ID NO: 2157 - DNA, 294 bp, Glycine max
  unsure (1)..(294): unsure at all n locations
agtcgcangcacgcgtacgtaagctcggaattcggctcgaggttcatatatctctctgctcttctcttctcttctacctcncaagtttttgaagtataaagatggcagagacattncctattcacctcggagtcagtgaacgagggacaccctgataagctctgcgaccaaatctccgatgctgtcctcgacgcttgcctcgaacaggacccagacagcaaggttgcctgcgaaacatgcaccaagaccaacttggttcatggtcttcggagagatcaccaccaaggccaacgt

SEQ ID NO: 2158 - DNA, 285 bp, Glycine max
  unsure (1)..(285): unsure at all n locations
cncgcacgcgtacgtaagctcggaattcggctcgagaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctggcaccaagaccaacatggtgatggttttcggagagat

SEQ ID NO: 2159 - DNA, 300 bp, Glycine max
  unsure (1)..(300): unsure at all n locations
gcacgngtacgtnagctcggaattcggctcgaggccatttgggagttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgnctgtgagactgcaccaagaccaacatggtcatggtctttg

SEQ ID NO: 2160 - DNA, 258 bp, Glycine max
  unsure (1)..(258): unsure at all n locations
gtcgcangcacgcgtacgtaagctcggaattcggctcgnnctcgagccgaatcggctcgagccaaccgatgaaacccccgagtaactgcccctcagccatnctccttgcaaccaaacttggngctcgcntcacagaggttaggaagaatggcacctgtgcttggttgaggccagatggtaagacacaagtaaccgtcgagtactacaatgacaatggtgccatggttccagttcgtgtccacactgtcctaatttcca

SEQ ID NO: 2161 - DNA, 335 bp, Glycine max
  unsure (1)..(335): unsure at all n locations
gtcgcangcncgcgtacgtnnagctcggaattcggctcgagcttgatttgaggccaggcaagccccactcaacnaccacacctctcctcgttcacgctacccctttctgctcttcttctaccttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaattggtcatggtcttcggagaaatcacgaccaaggccaacgtt

SEQ ID NO: 2162 - DNA, 287 bp, Glycine max
  unsure (1)..(287): unsure at all n locations
cgcaggaccccccacncnagctcggaattcggctcgagccaagncccactcaaccaccacaccactctctctgctcttcttctacctttcaagtnggtaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttggagagatcaccac

SEQ ID NO: 2163 - DNA, 319 bp, Glycine max
  unsure (1)..(319): unsure at all n locations
cngtangacgtcgcatgcacgcgtacgtaagctcggaaattcggctcgagngacntaacaacagcacaaagcgggttactgtctgttcaagntanccatctntgctctctctttcttagtgcctccttgcnagaagntanaatggcccaagnaaactttcctattcacatctgaatcagtgancgaggggcaccctgacaagctctgtgancagatctccgatgctgtgctcgatgcatgcttggagcaggaccctnacagcaaggttgcctgtgaaacctgcaccaagaccaanatggtgatngttttcggagagatc

SEQ ID NO: 2164 - DNA, 327 bp, Glycine max
  unsure (1)..(327): unsure at all n locations
nagnntntgcacgcgtacgtaagctcggaattcggctcnagcacaaagcgggttactggctgtncaagctaccattctctctctctctttcttagtgcctccttgccataagttaaaatggcccnagaaactttcctattcacatctgaatcagtgaacgaggggcaccctgacaagctctgtgaccagatctccgatgctgtgctcgatgcatgcttggagcaggaccctnacagcaaggttgcctgtgaaacctgcaccaagaccaacatggtgatggtttcggagagatcacgaccaaggncaantgggtntgagaagatngtg

SEQ ID NO: 2165 - DNA, 309 bp, Glycine max
  unsure (1)..(309): unsure at all n locations
gtcgcatgcacgcgtacgtaagctcggaattcggctcgagggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccanaaccaacttggtcatggtcttcggagaaatca

SEQ ID NO: 2166 - DNA, 260 bp, Glycine max
  unsure (1)..(260): unsure at all n locations
aagccccactcaaccaccacacctctcntcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatc

SEQ ID NO: 2167 - DNA, 266 bp, Glycine max
aggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttggctgcgaaacatgcaccaaaaccaacttggtcatggtcttcggagaaatcac

SEQ ID NO: 2168 - DNA, 313 bp, Glycine max
  unsure (1)..(313): unsure at all n locations
agncgntgcacgcgtacgtaagctcggaattcngctcgaggccaggcaagccccactcaaccaccacaccttctccttcgttcacgctacccctttctgcttcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccanaaccaacttggtcatggtcttcggagaaatcacg

SEQ ID NO: 2169 - DNA, 290 bp, Glycine max
  unsure (1)..(290): unsure at all n locations
angcacgcgtacgtaagctcggaattcggctcgaggccatttgggagttaggttctgcacgctctgcttccagcgagtgttctttcttcgtttcaacaccttaatttgcacacgctgcttcttcngcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaacatg

SEQ ID NO: 2170 - DNA, 261 bp, Glycine max
  unsure (1)..(261): unsure at all n locations
gtcgcangcacgcgtacgtaagctcggaattcggctcgagctcgagccgaattcggctcgnggagaaatcacgaccanggccaaanttgactacgagaaganngtgcgtgacacctgcaggancatcggcntcgtcncaaatgatgtgggactggangccgacaactgcaaggtcctcgtcaacatngagcagcanagccctganattgctcagggngtacncggccaccttaccaaaaaacctgaagaaattggtgcngg

SEQ ID NO: 2171 - DNA, 305 bp, Glycine max
  unsure (1)..(305): unsure at all n locations
gtgcattcgtacgtaagctcggaattcngctcgaggccaggcaagccccactcaaccaccacacctctcctcgttcacgctacccctttctgctcttcttctacctttcaagttttaaaagtataaagatggcagagacnttcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccancttggtcatggtcttcggagaaatcacg

SEQ ID NO: 2172 - DNA, 304 bp, Glycine max
  unsure (1)..(304): unsure at all n locations
tcgcangcacgcgtacgtaagctcggaattctnctcgaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcaga

SEQ ID NO: 2173 - DNA, 306 bp, Glycine max
  unsure (1)..(306): unsure at all n locations
ngangcacgcgtacgtaagctcggaattcngctcgaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcnaagttgcctgcgaaacatgcaccanaaccaacttggtcatggtcttcggagaaatcacganca

SEQ ID NO: 2174 - DNA, 283 bp, Glycine max
  unsure (1)..(283): unsure at all n locations
nnncanangcacgcgtacgtaagctcggaattcggctcgagcggctcgagaccactctctctgctcttcttctacctttcaagtttttaaagtattaagatggcagagacattcctatttaccttcagagtcagtgaacgagggacaccctgacaagctctgcgaccaaatctccgatgctgtcctcgacgcttgccttgancaggacccagacagcaaggttgcctgcgaaacatgcaccaagaccaacttggtcatggtcttcggagagatcaccaccaag

SEQ ID NO: 2175 - DNA, 321 bp, Glycine max
  unsure (1)..(321): unsure at all n locations
nngtcgcctgcacgcgtacgtnagctcggaattcggctcgaggttactgtctgttcaagctaccatctctctctctcttncttagtgcctccttgnccagaagttaaaatggcccaagaaactttcctattcacatctgaatcagtgaacgangggcacctgacaagctctgtgaccaganctccgatgctgtgctcgatgcatgcttggagcaggacctgacagcaaggttgcctgtgaaacctgcaccaagaccaacatggtgatggttttcggagagatcanaaccaagggccacngtgannaataaganatgtgcnt

SEQ ID NO: 2176 - DNA, 304 bp, Glycine max
  unsure (1)..(304): unsure at all n locations
aagcnccactcaaccaccacaccactctctctgntctncttctacctttcaagtttttaaagtattaagatggcanagacattcctatttacctcagagtcagtgaacganggacaccctgacaagctctgcgaccaaatntccgatgctgtcctcgacgcttgccttgaacaggacccagacagcaaggttgctgcggaaacatgcaccagaccacttggtcatggtcttngaganatcaccaccaaggccacgttgactacgagangatcgtgcgtgacacctgcagaacatcggcttcgtt

SEQ ID NO: 2177 - DNA, 297 bp, Glycine max
  unsure (1)..(297): unsure at all n locations
cacgcgtacgtaagctcggaattcggctcgaggcagacttancaacagcacaaagcgggttactgtcngttcaagctaccatctctctctctctttcttagtgcctccttgccagaagttaaaatggcncaagaaactttcntattcacatctgaatcagngaacgaggggcaccctgacaagctctgtgaccagatctccgatgctgtgctcgntgcatgcttggagcaggaccctganagcaaggttgcctgtgaaacctggcaccangaccaacatggtgatggttttcggaga

SEQ ID NO: 2178 - DNA, 310 bp, Glycine max
  unsure (1)..(310): unsure at all n locations
gtacangcacgcgtacgtaagctcggaattcggctcgaggcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagccaacatggtgatggttttcggagagatcacaa

SEQ ID NO: 2179 - DNA, 278 bp, Glycine max
  unsure (1)..(278): unsure at all n locations
cgcgtacgtnagctcggaattcggctcgagcttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatg

SEQ ID NO: 2180 - DNA, 281 bp, Glycine max
  unsure (1)..(281): unsure at all n locations
cgcatgcacgcgtacgtaagctcggaattcggctcgagcaacagcanaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatg

SEQ ID NO: 2181 - DNA, 305 bp, Glycine max
  unsure (1)..(305): unsure at all n locations
gnnnangcacgcgtacgtnagctcggaattcggctcgagggccaggcaagccccactcaaccaccacacctctcctcgnncacgctgacccctntctgctcttcttctacctttcaagttttaaaagtataaagatggcagagacattcctatttacctcagagtcggtgaacgagggacaccctgacaagctctgcgaccaaatctccgatgcngtcctcgacgcttgcctcgagcaggacccagacagcaaagttgcctgcgaaacatgcaccanaaccaacttggtcatggtcttcggagaa

SEQ ID NO: 2182 - DNA, 277 bp, Glycine max
gtcgcatgcacgcgtacgtaagctcggaattcggctcgagcacaaagcgggtcactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatg

SEQ ID NO: 2183 - DNA, 187 bp, Glycine max
tagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatg

SEQ ID NO: 2184 - DNA, 282 bp, Glycine max
  unsure (1)..(282): unsure at all n locations
tcgcangcacgcgtacgtaagctcggaattcngctcgagcaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatg

SEQ ID NO: 2185 - DNA, 315 bp, Glycine max
  unsure (1)..(315): unsure at all n locations
gtcgcangcacgcgtacgtaagctcggnattcggctcganctcgagccgaattcgggctcgantatacaacagcacaaagcgggactactgtctgttcaagactaccatctctntctctctttcttagtgcctccttgccagaagttaaaatggcccaanaaactttcctattcacatctgaatcngtgaacgaggggcaccctgacaagctctgtgaccagatctccgatgctgtgctcgatgcatgcttggagcaggaccctgacagcaaggttgcctgtgaaacctgcaccaagaccaacatggtgatggtt

SEQ ID NO: 2186 - DNA, 303 bp, Glycine max
  unsure (1)..(303): unsure at all n locations
anacgcangcacgcgtacgtaagctcggaattcngctcgagggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgnaccaaaaccaacttggtcatggtcttcggagaaat

SEQ ID NO: 2187 - DNA, 297 bp, Glycine max
  unsure (1)..(297): unsure at all n locations
acgtcgcangcacgcgtacgtaagctcggaattcngctcgaggccccactcaaccaccacaccnctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaa

SEQ ID NO: 2188 - DNA, 276 bp, Glycine max
  unsure (1)..(276): unsure at all n locations
cgcntgcacgcgtacgtnagctcggaattcggctcgaggcacaaagcgggttactgtctgttcaagctaccatctctctctctctttcttagtgcctcnttgccagaagttaaaatggcccaagaaactttcctattcacatctganccagtgaacgaggggcaccctgacaagctctgtgaccagatctccgatgctgtgctcgatgcatgcttggagcaggaccctgacagcaaggttgcctgtgaaacctgcaccaagaccaacatggtgatg

SEQ ID NO: 2189 - DNA, 300 bp, Glycine max
  unsure (1)..(300): unsure at all n locations
ngtcgcangcacgcgtacgtaagctcgggaattcngctcgaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggaga

SEQ ID NO: 2190 - DNA, 283 bp, Glycine max
  unsure (1)..(283): unsure at all n locations
gcntangtacgcnnacgtaagctcggaattcggctcgagccaccacacctctcctcgttcacgctacccctttcngctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaa

SEQ ID NO: 2191 - DNA, 303 bp, Glycine max
  unsure (1)..(303): unsure at all n locations
tcgtcgcangcacgcgtacgtaagctcggaattcggctcgagaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaa

SEQ ID NO: 2192 - DNA, 320 bp, Glycine max
  unsure (1)..(320): unsure at all n locations
tntcnnncnaaagtcgcatgcacgcntacgtaagctcgggaattcggctcgagggccaggcaagccccactcaaccaccacacctctcctcgttcacgctacccctttctggctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaa

SEQ ID NO: 2193 - DNA, 301 bp, Glycine max
  unsure (1)..(301): unsure at all n locations
agttnngcacgcgtacgtaagctcggaattcggctcgagaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaa

SEQ ID NO: 2194 - DNA, 284 bp, Glycine max
gcatgcacgcgtacgtaagctcggaattcggctcgagccaagccccactcaaccaccacaccactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtctcggagagatcacc

SEQ ID NO: 2195 - DNA, 288 bp, Glycine max
  unsure (1)..(288): unsure at all n locations
ncacgtcgcangcacgcntacgtaagctcggaattcggctcgagcaacagcacaaagcgggttactgtctgttcaagctaccatctctctctctctttcttagtgcctccttgccagaagttaaaatggcccaaganactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtgatgg

SEQ ID NO: 2196 - DNA, 292 bp, Glycine max
  unsure (1)..(292): unsure at all n locations
cgcnttacgcgtacgtaagctcggaattcggctcgaggccatttgggagttaggttctgcacgctctgcttccagcgagtgttctttcttcgtttcaacaccttaatttgcacacgctgcttcttcngcttgagaaatggcacaaaaacctttctattcacatctgaatctgtaaacganggtcaccccgacaagctgtgcgaccagatctctgatgcagtgctcgatgcgtgccttgaacaggaccctgacagcaangttgcctgtgagacatgcaccangaccaacatgg

SEQ ID NO: 2197 - DNA, 316 bp, Glycine max
  unsure (1)..(316): unsure at all n locations
ctcngctcgcntacgtnanctcggaattcggctcgagnnatttgaggccaggcaagcnccactcaaccaccacacctctcctcgttcacgctacccctttctgctcttcttctacctttcaagttttaaaagtataaagatggcaganacattcctatttacctcagagtcggtgaacgagggacaccctgacaagctctgcgaccaaatctccgatgctgtcctcgacgcttgcntcgagcaggacccagacagcaaagttgcctgcnanacatgcaccaaaaccaacttggtcatggtcttcggagaaatcacg

SEQ ID NO: 2198 - DNA, 305 bp, Glycine max
  unsure (1)..(305): unsure at all n locations
cgcatgcagcgtacgtnagctcggaattcggctcgaggngccaggcaagccccactcaaccaccacacctctcctcgttcacgctacccctttctgctcttcncnctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaanaccaacttggtcatggtcttcggagaaa

SEQ ID NO: 2199 - DNA, 301 bp, Glycine max
  unsure (1)..(301): unsure at all n locations
ngtcgcangcacgcgtacgtaanctcggaattcggctcgagtttgggagttaggttctgcacgctctgcttccagcgagtgttctttcttcgtttcaacaccttaatttgcacacgctgcttcttcagcttgagaaatggcacaagaaacctttctattcanatctgaatctgtaaacgagggtcaccccgacaagctgtgngaccagatctctgatgcagtgcccgatgcgtgccttgaacaggnccctgacancaaggttgcctgtgagacatgnaccaagaccaanatggtcatgttt

SEQ ID NO: 2200 - DNA, 289 bp, Glycine max
  unsure (1)..(289): unsure at all n locations
gtcgcangcacgcgtacgtaagctcggaattcggctcgaggacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccnacatggtgat

SEQ ID NO: 2201 - DNA, 309 bp, Glycine max
  unsure (1)..(309): unsure at all n locations
gtcgcatgcacgcntacgtaagctcggaattnngctcgagggccaggcaagccccactcaaccaccacacctctcctcgttcacgctacccctttctggctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccanaaccaacttggtcatggtcttcggagaaatc

SEQ ID NO: 2202 - DNA, 250 bp, Glycine max
  unsure (1)..(250): unsure at all n locations
gcagacttaacaacagcacaaagcgggttactgtctgttcaagctaccatctctctctctnctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggt

SEQ ID NO: 2203 - DNA, 295 bp, Glycine max
  unsure (1)..(295): unsure at all n locations
gtcgcatgcacgcgtacgtaagctcggaattcggctcgaggccccactcaaccaccacacntctcctcgttcacgctacccctttctgctcttcttctacctttcaagttncaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagag

SEQ ID NO: 2204 - DNA, 272 bp, Glycine max
  unsure (1)..(272): unsure at all n locations
gncgcngcacgcgtacgtnagctcggnattcggctcgagggccccactcaaccaccacaccactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtcttc

SEQ ID NO: 2205 - DNA, 276 bp, Glycine max
  unsure (1)..(276): unsure at all n locations
cgtcgcangcacgcgtacgtaagctcggaattcggctcgagccaagccccactcaaccaccacaccactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgcctgcgaaacatgcaccaagaccaacttggtcatggtctt

SEQ ID NO: 2206 - DNA, 307 bp, Glycine max
  unsure (1)..(307): unsure at all n locations
ntcntatgcacgcgtacgtaagctcggaattcggctcgagggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcggagaaat

SEQ ID NO: 2207 - DNA, 311 bp, Glycine max
  unsure (1)..(311): unsure at all n locations
tcgcangcacgcgtacgtnagctcggaattcggctcgaggccatttgggnagttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgcctgaacaggaccctgacagcaaggttgcctgtgagacatgcaccaagaccaacatggtcaggtcttggagaga

SEQ ID NO: 2208 - DNA, 310 bp, Glycine max
  unsure (1)..(310): unsure at all n locations
nnncgcatgcacgcgtacgtaagctcggaattcggctcgaggactgttatgtttaaattgtagtcatggtggtgtttttggctgtgaatttgctcatatgtgctaattatgtgttcttgtttgatgttactctacagaagttaaaatggcccaagaaactttcctattcacatctgaatcagtgaacgaggggcaccctgacaagctctgtgaccagatctccgatgctgtgctncgatgcatgcttggagcaggaccctgacagcaangttgcctgtgaaacctgcaccaagaccaacatggtgatggt

SEQ ID NO: 2209 - DNA, 338 bp, Glycine max
  unsure (1)..(338): unsure at all n locations
tcgcatgcacgcgtacgtaagctcggaattcnnctcgaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaactccgatgctgtcctcgacgcttgcctcgagcaggacccagacagcaaagttgcctgcgaaacatgcaccaaaaccaacttggtcatggtcttcggagaaatcacgaccaggccaagttgattacgagaagtagtgcgtga

SEQ ID NO: 2210 - DNA, 288 bp, Glycine max
  unsure (1)..(288): unsure at all n locations
antcncangcacgcgtacgtaagctcggaattcggctcgagaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttgganccaggaccctgacagcaaggttgcctgtgaaacctgcaccaagaccaacatggtgatggttt

SEQ ID NO: 2211 - DNA, 311 bp, Glycine max
gtcgcatgcacgcgtacgtaagctcggaattcggctcgagggccaggcaagccccactcaaccaccacacctctcctcgttcacgctaccctttctgctcttcttctacctttcaagttttaaaagtataaagatggcagagacattcctatttacctcagagtcggtgaacgagggacacctgacaagctctgcgaccaaatctccgatgctgtcctcgacgcttgcctcgagcaggacccagacagcaaagttgcctgcgaaacatgcaccaaaaccaacttggtcatggtcttcggagaaatcacgac

SEQ ID NO: 2212 - DNA, 328 bp, Glycine max
  unsure (1)..(328): unsure at all n locations
angtctcangcacgcgtacgtaagctcggaattcagctcgagcngctcgagcacacctctcctcgttcacgctacccctttctgctctncttctacctttcaagttttnaangtntaaaggtggcagagacattcctatttacctcagagtcgntgaacgagggacaccctgnnaagctctgcgaccaaatctccgatgctgtcctcgacgcttgcctcgagcaggacccagacagnaaagttgcntgcgaaacatncaccaaaaccaattggtcatggtcttcggagaaatcacgaccaaggccaacgttgatacgagaagatatgc

SEQ ID NO: 2213 - DNA, 309 bp, Glycine max
  unsure (1)..(309): unsure at all n locations
acgtcgcangcacgcgtacgtaagctcggaattcggctcgagcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaattggtcatggtcttcggagaaatcacgacca

SEQ ID NO: 2214 - DNA, 299 bp, Glycine max
cgtcgcatgcacgcgtacgtaagctcggaattcggctcgagcaaattgtgaaggagaatttcgacttcagacctggaatgatcaccattaacttggaccttaagaggggtggtcataggttcctcaagacagctgcttatggacactttggaagggatgatgcagacttcacctgggaagttgtgaagccactcaagtcagagaagcctcaagcttaagagtgttgttaagttaatcactcccttcagtggatgtcttgctgggtgtggatgaataatttgcgtgtttcatgactacta

SEQ ID NO: 2215 - DNA, 297 bp, Glycine max
  unsure (1)..(297): unsure at all n locations
ngtcgcangcacgcgtacgtaagctcggaattcggctcgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtct

SEQ ID NO: 2216 - DNA, 298 bp, Glycine max
  unsure (1)..(298): unsure at all n locations
gtcgcangcacgcgtacgtnagctcggaattcggctcgggggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccannaccaacttggtcatggtctt

SEQ ID NO: 2217 - DNA, 284 bp, Glycine max
  unsure (1)..(284): unsure at all n locations
tcgcangcacgcgtacgtaagctcggaattcggctcgagcttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtg

SEQ ID NO: 2218 - DNA, 298 bp, Glycine max
  unsure (1)..(298): unsure at all n locations
ttgcatgcangcgtacgtaanctcgggaattcggctcgagnggagttaggttctgcacgctctncttccagcgagtgttctttcntcgtttcaacaccttaatttgcangacgctgcttntnaaganttgagaaatggcacaagaaacctttctattcacatctgaatctntaaacgagggtcaccccganaagctgtgcgancagatctctnatgcagtgctcgatgcgtgccttgaacaggacnctgacagcaaggttgcctgtgagacatgcaccaagaccaacatggcatggtc

SEQ ID NO: 2219 - DNA, 303 bp, Glycine max
  unsure (1)..(303): unsure at all n locations
gtngnnggcnnngnacggtacgtgagctcggaattcggctcgagcaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcagcaaaaccaacttggtcatggtcttcggn

SEQ ID NO: 2220 - DNA, 301 bp, Glycine max
  unsure (1)..(301): unsure at all n locations
ttacatgcacacgtacgtaagctcggaattcngctcgagaggcaagcnccactcaaccaccacacctctcctcgttcacgctacccctttctgctcttcttctacctttcnagttttaaaagtataaagatggcagagacattcctatttacctcagagtcggtgaacgagggacaccctgacaagctctgcgaccaaatctccgatgctgtcctcgacgcttgcctcgagcaggacccagatagcaaagttgcctgcnaaacatgcaccaaaaccaacttggtcatggtcttcggagaaa

SEQ ID NO: 2221 - DNA, 304 bp, Glycine max
  unsure (1)..(304): unsure at all n locations
agtcgcangcacgcgtacgtaagctcggaattcggctcgaggggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccagaaccaacttggtcatggtcttcgga

SEQ ID NO: 2222 - DNA, 311 bp, Glycine max
  unsure (1)..(311): unsure at all n locations
tancgcatgcacgcgngtaanntnnnaatcggnattcggctcgagtttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgatcaaatctccgatgctgtcctcgacgcttgcctcgagcaggacccagacagcaaagttgcctgcgaaacatgcaccaaaaccaacttggtcatggtcttcgg

SEQ ID NO: 2223 - DNA, 284 bp, Glycine max
  unsure (1)..(284): unsure at all n locations
annctaatgcacgcgtacgtaagctcggaattcggctcgagaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtga

SEQ ID NO: 2224 - DNA, 299 bp, Glycine max
  unsure (1)..(299): unsure at all n locations
nncnaannnncgcatgcacgcgtacgtaagctcggaattcggctcgaggcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatggtga

SEQ ID NO: 2225 - DNA, 324 bp, Glycine max
  unsure (1)..(324): unsure at all n locations
agtcgcangcacgcgtacgtaagctcggaattcggctcgagatttgaggccaggcaagccccactcaaccaccacacntctncncgttcacgctacccctttctgnctcttcttgctncctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcganacatgcaccaaaaccaacttggtcatggtctnggagaaatcacgaccaa

SEQ ID NO: 2226 - DNA, 304 bp, Glycine max
  unsure (1)..(304): unsure at all n locations
ntcgcangcacgcgtacgtaagctcggaattcggctcgagggccaggcaagccccactcaacnaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgncgcttgcctcgagcaggacccagacagcaaagttgcctgcgaaacatgcaccanaaccaacttggtcatggtcttcggaga

SEQ ID NO: 2227 - DNA, 300 bp, Glycine max
gtcgcatgcacgcgtacgtaagctcggaattcggctcgagcaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcagcaaaaccaacttggtcatggtcttcggag

SEQ ID NO: 2228 - DNA, 302 bp, Glycine max
  unsure (1)..(302): unsure at all n locations
ngtcgcangcacgcgtacgtaagctcggaattcggctcgagggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcnaagttgcctgcgaaacatgcaccaaaaccaacttggtcatggtcttcgg

SEQ ID NO: 2229 - DNA, 298 bp, Glycine max
  unsure (1)..(298): unsure at all n locations
gtcgcangcacgcgtacgtaagctcggaattcggctcgagcaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcancaaaaccaacttggtcatggtcttcgg

SEQ ID NO: 2230 - DNA, 298 bp, Glycine max
  unsure (1)..(298): unsure at all n locations
ttanagtcgcangcacgcgtacgtaagctcggaattcnnctcgagncaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttc

SEQ ID NO: 2231 - DNA, 269 bp, Glycine max
  unsure (1)..(269): unsure at all n locations
tgatttgaggccaggcaagcccngctcaaccaccacacntctcctcgttcacgctacccctttctnctcttcttctacctttcangttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcgg

SEQ ID NO: 2232 - DNA, 290 bp, Glycine max
  unsure (1)..(290): unsure at all n locations
ncaattaanagtcgcangcacgcgtacgtaagctcggaattcggctcgaggttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctgacagcaaggttgcctgtgagacatgcaccaagaccaa

SEQ ID NO: 2233 - DNA, 306 bp, Glycine max
  unsure (1)..(306): unsure at all n locations
gtcgcangcacgcgtacgtaagctcggaattcggctcgagggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccanaaccaacttggtcatggtcttcggagaaa

SEQ ID NO: 2234 - DNA, 311 bp, Glycine max
  unsure (1)..(311): unsure at all n locations
tnangnacgcgtacgtaagctcggaattcggctcgagcngctcgaggcaagccccactcaaccaccacacacgctcctcgtncacgctacccctttctggctcttcttctaccnttcaagttttaaaagtataaagatggcagagacattcctatttacctcagagtcggtgaacgagggacaccctgacaagctctgcgaccaaatctccgatgctgtcctcgacgcttgcctcgagcaggaccagacagcaaagttgcctgcgaaacatgcaccaaaaccaacttggtcatggtcttcggagaaatcac

SEQ ID NO: 2235 - DNA, 289 bp, Glycine max
  unsure (1)..(289): unsure at all n locations
natcgcatgcacgcgtacgtnagctcggaattcggctcgagcaacagcacaaagcgggttactgtctgttcaagctaccatctctctctctctttcttagtgcctccttgccagaagttaaaatggcccaagaaactttcctattcacatctgaatcagtgaacgaggggcaccctgancaagctctgtgaccagatctccgatgctgtgctcgatgcatgcttggagcaggaccctgacagcaaggttgcctgtgaaacctgcaccaagaccaacatggtgatggttt

SEQ ID NO: 2236 - DNA, 260 bp, Glycine max
  unsure (1)..(260): unsure at all n locations
agcagacttaacaacagcacaaagcgggttactgtctgttcaagctaccannnnnnnnnnnnnnnnntagtgcctccttgccagaagttaaaatggcccaagaaactttcctattcacatctgaatcagtgaacgaggggcaccctncacaagctctgtgaccagatctccgatgctgtgctcgatgcatgcttggagcaggaccctgacagcaaggttgcctgtgaaacctgcaccaagaccaacatggtgatggtttt

SEQ ID NO: 2237 - DNA, 298 bp, Glycine max
  unsure (1)..(298): unsure at all n locations
ntcanntacgcgtangtancactgcgtacntnagctcggaattcggctcgagcagcacaaagcgggttactgtctgttcaagctaccatctctctctctctttcttagtgcctccttgccagaagttaaaatggcccaagaaactttcctattcacatctgaatcagtgaacgaggggcaccctgtacaagctctgtgaccagatctccgatgctgtgctcgatgcatgcttggagcaggaccctgacagcaaggttgcctgtgaaacctgcaccaagaccaacatggtgatggtttt

SEQ ID NO: 2238 - DNA, 301 bp, Glycine max
  unsure (1)..(301): unsure at all n locations
tcgcngaacgngtacgtaagctcggaattcggctcgangncatttgggagttaggtttnaacgctcngcgtnnagngagtgatntttcttcgtntcancacntnaaattgcancacgctgcttcttcngcttgagaaatggcacaagaaacctttctattcacatctgaatctgtaaacganggtcaccccgacaagctgtgtgaccagatctctgatgcantgctcgatgcgngccttgaacaggaccctgacagcaagttgcctgtgagacatgcaccatgaccaacatggtcaggtcn

SEQ ID NO: 2239 - DNA, 309 bp, Glycine max
  unsure (1)..(309): unsure at all n locations
acgtcgcangcacgcgtacgtaagctcggaattcngctcgaggcaagccccactcaaccaccacacctctcctcgttcacgctacccctttctgctacttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaacatgcaccaaaaccaacttggtcatggtcttcggagaaatcacgac

SEQ ID NO: 2240 - DNA, 293 bp, Glycine max
  unsure (1)..(293): unsure at all n locations
ngtcgcangcacgcgtacgtaagctcggaattcggctcgagttaacaacagcacaaagcgggttactgtctgttcangctaccatctctctctctctttcttagtgcctccttgccagaagttaaaatggcccaagaaactttcctattcacatctgaatcagtgaacgaggggaccctgacaagctctgtgaccagatctccgatgctgtgctcgatgcatgcttggagcaggnccctgacagcaaggttgcctgtgaaacctgcaccaagaccaacatggtgatggttttc

SEQ ID NO: 2241 - DNA, 279 bp, Glycine max
acgcgtacgtaagctcggaattcggctcgagctcgagccgcagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaacctgcaccaagaccaacatggtgatg

SEQ ID NO: 2242 - DNA, 181 bp, Glycine max
tagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatg

SEQ ID NO: 2243 - DNA, 289 bp, Glycine max
  unsure (1)..(289): unsure at all n locations
acgtcgcangcacgcgtacgtaagctcggaattcggctcgaggcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatg

SEQ ID NO: 2244 - DNA, 287 bp, Glycine max
  unsure (1)..(287): unsure at all n locations
nncgcangcacgcgtacgtaagctcggaattcggctcgaggcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatg

SEQ ID NO: 2245 - DNA, 310 bp, Glycine max
  unsure (1)..(310): unsure at all n locations
aagtcgcatgcacgcntacgnaagctcggcattnggcncgcggnccaggcaagcaccactcaaccancacacatctnctcgttcaagctacccctttgtncnctncttctaantttcaagttttaaaagtatacagatggcagagacattcctatttacctcagagtcggtgaacgagggacaccntgacaagctctgcgaccaaatctccgatgctgtcctcgacgcttgcntcgagcaggacccagacagcaangttgcctgcgaaacatgcaccngaaccaacttggtcatggtcttcggagaaatc

SEQ ID NO: 2246 - DNA, 284 bp, Glycine max
  unsure (1)..(284): unsure at all n locations
ngtcgcangcacgcgtacgtnagctcggaattcggctcgagccancacacctctcctcgttcacgctacccctttctgctcttcttctacctttcaagtttnaaangtntaaagatggcagagacatncctatttacctcagagtcggtgaacgagggacacccngacaagctctgcgaccaaanctccgatgcngtcctcgacgcttgcctcgagcaggacccagacagcaaagntgcctgcgaaacangcaccaaaaccaacttggtcatggtcttcggaga

SEQ ID NO: 2247 - DNA, 299 bp, Glycine max
  unsure (1)..(299): unsure at all n locations
ntntcgcangcacgcgtacgtaagctcggaattcggctcgaggccaggcaagccccactcaaccaccacactggctcctcgttnacgctacccctttctncctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtc

SEQ ID NO: 2248 - DNA, 182 bp, Glycine max
tagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatgg

SEQ ID NO: 2249 - DNA, 313 bp, Glycine max
  unsure (1)..(313): unsure at all n locations
tgcgngcacgcgtacgtnagctcggntnttcggctcgaggcagacttaacaacagcncananccnggttactnnctgtncaagctanccatctctctctctctttcttagtgcctccttgccagaagttaaaatggcccaagaaactttcctanncacatctgaatcagtgaancgaggggcacctgacaagctctgtgaccagatctccgatgctgtgctcgatgcncgnttggagcaggaccctgacagcaaggttgcctgtgaaaccngcaccaagaccaacatggtgatggttttcggaganntcacaa

SEQ ID NO: 2250 - DNA, 289 bp, Glycine max
  unsure (1)..(289): unsure at all n locations
gcacgcgtacgtaagctcggaattcggctcgagcaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcancaaaaccaacttggtcatggtcttc

SEQ ID NO: 2251 - DNA, 264 bp, Glycine max
  unsure (1)..(264): unsure at all n locations
atttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccancttggtcatggtctt

SEQ ID NO: 2252 - DNA, 315 bp, Glycine max
  unsure (1)..(315): unsure at all n locations
gtcgcatgcacgcgtacgtaagctcggaattcggctcgaggcaagccccactcaaccaccacacctctcctcgttcacgctacccctttctgctcttcttctacctttcaagttttaaaagtataaagatggcagagacattcctatttacctcagagtcggtgaacgagggacaccctgaaagctctgcgaccaaatctccgatgctgtcctcgacgcttgcctcgagcaggacccagacagcaaagttgcctgcgaaacatgcacnaaaaccaattggtcatggtcttcggagaaatcacgaccaaggccaag

SEQ ID NO: 2253 - DNA, 191 bp, Glycine max
tagtgcctccttgccagaagttaaaatggcccaagaaactttcctattcacatctgaatcagtgaacgaggggcaccctgacaagcttgtgaccagatctccgatgctgtgctcgatgcatgcttggagcaggaccctgacagcaaggttgcctgtgaaacctgcaccaagaccaacatggtgatggtttt

SEQ ID NO: 2254 - DNA, 304 bp, Glycine max
  unsure (1)..(304): unsure at all n locations
gttgcangcacgcgtacgtaagctcggaattcggctcgagagcagacttaacaacagcacaaagcgggttactgtctgttcaagctnncanctctctctctctttcttagtgcctccttgccagaagttaaaatggcccaagaaactttcctattcacatctgaatcagtgaacgangggcaccctgtgcaagctctgtgaccagatctccgatgctgtgctcgatgcatgattggagcaggaccctgacagcaaggttgnctgtgaaacctgcaccaagancaacatggtgatggttttcgga

SEQ ID NO: 2255 - DNA, 317 bp, Glycine max
  unsure (1)..(317): unsure at all n locations
tcgcatgcncgcgtacgtnagctcggnattcggctcgagcanaangcnggttactgtctgttcaagctaccatctctctctctctttcttantgcctccttgccagangttaaaatggcncaagaanctttcctattcacatctgaatnngtgaacgaggggcaccctgaacaanctctgtgancagatctccgatgctgtgctcgntgcatncttggagcaggaccctgacagcnaggttncctgtgnaacntgcaccaagnccancatggngatggttttcggaganntcacaaccanggccaacgtggactatg

SEQ ID NO: 2256 - DNA, 235 bp, Glycine max
  unsure (1)..(235): unsure at all n locations
cngcacgcgtacgtaagctcggaattcggctcgagggagattggtgctggtgaccaaggtcatatgttcggctatgnnctgacgangntcccgagctcatgcccntgagccatgtccttgccacgaagctcggtgtcaagctcancgaggttcggaanaacgggacatgcccttggctgaganctgntggcaagaccnaggtcantgttgnnnactacaatggcaagggngccat

SEQ ID NO: 2257 - DNA, 319 bp, Glycine max
cgatgcacgcgtacgtaagctcggaattcggctcgagtttggggagttaggttctgcacgctctgcttccagcgagtgttctttcttcgtttcaacaaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctgacagcaagttgcctgtgagacatgcaccaagaccaactggtcaggtctttggagagatcacaaccagggc

SEQ ID NO: 2258 - DNA, 306 bp, Glycine max
gtcgcatgcacgcgtacgtaagctcggaattcggctcgagcaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaacaaaaccaattggtcatggtcttcggagaaatcac

SEQ ID NO: 2259 - DNA, 300 bp, Glycine max
  unsure (1)..(300): unsure at all n locations
acgtcgcangcacgcgtacgtaagctcggaattcggctcgagcttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaaccaagaccaacatggtgatggnttncgga

SEQ ID NO: 2260 - DNA, 330 bp, Glycine max
  unsure (1)..(330): unsure at all n locations
gtcgcatgcacgcgtacgtaagctcggaattnggctcgagctcgagccgcaggaaagccccactcaaccaccacacctctcctcgttcacgctaccccttaactgcttcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccacttggtcatggtcttcggagaaatcagaccaaggccaagt

SEQ ID NO: 2261 - DNA, 180 bp, Glycine max
  unsure (1)..(180): unsure at all n locations
tagtgcctccttgccagaagttaaaatggcccaagaaactntcctattcacatctggatcagtgaacgaggggcaccctgacaagctctgtgaccagatctccgatgctgtgctcnntgcatgcttggagcaggancctgacagcaaggttgcctgtgaaacctgcaccaagaccaacat

SEQ ID NO: 2262 - DNA, 286 bp, Glycine max
gtcgcatgcacgcgtacgtaagctcggaattcggctcgagcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatg

SEQ ID NO: 2263 - DNA, 300 bp, Glycine max
  unsure (1)..(300): unsure at all n locations
gtcgcangcacgcgtacgtaagctcggaattcggctcgagtttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccnacttggtcatggt

SEQ ID NO: 2264 - DNA, 332 bp, Glycine max
  unsure (1)..(332): unsure at all n locations
cgcangcacgcgtacgtaagctcggaattcggctcgagcgacttaacaacagcacaaagcgggttactgtctgttcaagctaccatctctctctctctttcttagtgcctcnttgccagaagttaaaatggcccaagaaactttcctattcacatctgaatcagtgaacgaggggcaccctgacaagctctgtgaccagatctccgatgctgtgctcgntgcatgcttggagcaggaccctgacagcaaggttgcctgtgaaacctgcaccaagaccaacatgtgatggtttcggagagntcacaaccangcaacgtggactatgagaggtt

SEQ ID NO: 2265 - DNA, 274 bp, Glycine max
  unsure (1)..(274): unsure at all n locations
tcacgngtacgtnagctcggaattcggctcnagcttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacat

SEQ ID NO: 2266 - DNA, 300 bp, Glycine max
  unsure (1)..(300): unsure at all n locations
gcnannnaggnnagtcgcangcacgcgtacgtaagctcggaattcggctcgaggcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcaccaagaccaacatn

SEQ ID NO: 2267 - DNA, 288 bp, Glycine max
  unsure (1)..(288): unsure at all n locations
ngtcgcangcacgcgtacgtaagctcggaattcngctcgaggccccactcaaccaccacacntctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagnnaagttgcctgcgaaacatgcaccaaaaccaacttggtcatggtct

SEQ ID NO: 2268 - DNA, 291 bp, Glycine max
  unsure (1)..(291): unsure at all n locations
gttgcangcacgcgtacgtaagctcggaattcggctcgagatttggagtttggagcgactnaactaatcattaatttgcactcgctgtttcagcttcatcaccctttcttttgcatcatttatatctcttgagaaatggcacaagaaacctntctattcacatctgaatctgtaaacgagggtcaccccgacangctgtgcgancagatctctgatgcagtacttgatgcgtgccttgaacaggaccctgacagcaaggttgccngtgagacatgnaccaagaccaacatg

SEQ ID NO: 2269 - DNA, 298 bp, Glycine max
  unsure (1)..(298): unsure at all n locations
cacgcgtacgtaagctcggaattcggctcgagncaaaggagtgatttggagtttggagcgactgaactaatcattaatttgcactcgctgtttcagcttcatcacccttcttttgcatcatttatatctcttgagaaatggcacaagaaacctttctattcacatctgaatctgtaaacgagggtcaccccgacangctgtncnaccagatctctgatgcagtacttgatgcgtgccttgaacnggaccctggacagcaaggttgcctgtgagacatgcaccaagaccaacatggtct

SEQ ID NO: 2270 - DNA, 296 bp, Glycine max
  unsure (1)..(296): unsure at all n locations
gtcgcangcacgcgtacgtaagctcggaattcggctcgaggcagacttaacaacagcacaaagcgggttactgtctgttcaagctaccatctnctctctctctttcttagtgcctccttgccagaagttaaaatggcccaagaaactttcctattcacatctgaatcagtgaacgaggggcaccctgaacaagctctgtgaccagatctccgatgctgtgctcgatgcatgcttggagcaggaccctgacagcaaggttgcctgtgaaacctgcaccaagaccaacatggtgatgg

SEQ ID NO: 2271 - DNA, 288 bp, Glycine max
  unsure (1)..(288): unsure at all n locations
gtcncatgcacgcgtacgtaagctcggaattcggctcgaggacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccnncgacagcaaggttgcctgtgaaacctgcaccaagaccaacatggtg

SEQ ID NO: 2272 - DNA, 299 bp, Glycine max
  unsure (1)..(299): unsure at all n locations
nagtcgcatgcacgcgtacgtaagctcggaattcngctcgaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatggcaccaaaaccaacttggtcatggtcttcgga

SEQ ID NO: 2273 - DNA, 300 bp, Glycine max
  unsure (1)..(300): unsure at all n locations
gcngcacgcgtacgtaagctcggaattcggctcgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccanaaaccaacttggtcatggtcttcggaga

SEQ ID NO: 2274 - DNA, 297 bp, Glycine max
  unsure (1)..(297): unsure at all n locations
acgtcgcangcacgcgtacgtaagctcggaattcggctcgagggagtttggagcgactgaactaatcattaatttgcactcgctgtttcagcttcatcacccttcttttgcatcatttatatctcttgagaaatggcacaagaaacctttctattcacatctgaatcgtaaacnagggtcaccccgacaagctgtncnatcagatctctgatgcagtacttgatgcntgccttgancaggnccctgacagcaaggttgcctgtgagacntgcaccaagaccaacatggtcatggtct

SEQ ID NO: 2275 - DNA, 296 bp, Glycine max
  unsure (1)..(296): unsure at all n locations
gcangcacgcgtacgtnagctcggaattcngctcgaggccccactcaaccaccacacctctcctcgttcacgctacccctttctgctcttcttctacctttcaagttttaaaagtataaagatggcagagacattcctatttacctcagagtcggtgaacgagggacaccctgacaagctctgcgacnnaatctccgatgctgtcctcgacgcttgcctcgagcaggacccagacagcaaagttgcctgcgaaacatgcaccaaaaccaattggtcatggtcttcggagaaatcac

SEQ ID NO: 2276 - DNA, 306 bp, Glycine max
  unsure (1)..(306): unsure at all n locations
acgtcgcangcacgcgtacgtnagcnncggaattcngctcgagcaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaattggtcatggtcttcggagaaat

SEQ ID NO: 2277 - DNA, 287 bp, Glycine max
  unsure (1)..(287): unsure at all n locations
tcgcangcacgcgtacgtaagctcggaattcggctcgagggccaggcaagccccactcaaccaccacacnnctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttgg

SEQ ID NO: 2278 - DNA, 206 bp, Glycine max
  unsure (1)..(206): unsure at all n locations
gccacttaccanaaaacctgaagaaattggtgctgntgaccagggtcacatgtttggctatgccactgatgaaacccctgaattgatgccattgagccatgttcttgcaacaaaactcggtgctcgtctcaccgaggttcgcnagaacggtactggccttggctgangctgatggaagacccaagtgaccgttgagtatacaatga

SEQ ID NO: 2279 - DNA, 265 bp, Glycine max
  unsure (1)..(265): unsure at all n locations
tgcacgcacgcgtacgtnagctcggaattcggctcgagacagcacaggagcgggttacngtctgttcaagctaccatctctctctctctttcntagtgcctccttgccagaagttaaaatggcccaagaaactttcctattcacatctgaatcagtgaacgaggggcaccctgacaagcnctgcgaccagatctccgatgctgtgctcgatgcatgcttggagcaggaccctgacagcaaggttgcctgtgaaacctgcaccaag

SEQ ID NO: 2280 - DNA, 291 bp, Glycine max
  unsure (1)..(291): unsure at all n locations
nanngcncgngtacgtaagctcgganttcggctcgagggccaggcaagccccactcaaccaccacacctctcctcgttcacgctaccccttngtgctcttcttctacctttcaagttttaaaagtataaagatggcagagacattcctatttacctcagagtcggtgaacgagggacaccctgacaagctctgcgaccaantctccgatgctgtcctcgacgcttgcctcgagcaggacccagacagcaaagttgcctgcgaaacatgcaccataaccaacttggtcatgg

SEQ ID NO: 2281 - DNA, 330 bp, Glycine max
  unsure (1)..(330): unsure at all n locations
gcacgcgtacgtaagctcggaattcggctcgagatttgaggccaggcaagccccactcaaccaccacacctctcctcgttcacgctaaccctttctgctcttcttctacctttcaagttttanaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatggcaccaaaaccaattggtcatggtcttcggagaaatcagaccaggccaagttgattacga

SEQ ID NO: 2282 - DNA, 283 bp, Glycine max
  unsure (1)..(283): unsure at all n locations
tcgcangcacgcgtacgtaagctcggaattcngctcgaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttggtc

SEQ ID NO: 2283 - DNA, 302 bp, Glycine max
  unsure (1)..(302): unsure at all n locations
ncgtcgcatgcncgcgtacgtaagctcggaattcggctcgngngccaggnaagccccactcaaccaccacacctctcctcgttcacgctacccctttctgctcttcttctacctttcangttttaaaagtataaagatggcagagacattcctatttacctcagagtcggtgnacgagggncaccctgacaagctctgcgaccaaatctccgatgctgtcctcgacgcttgcctcgngcnggacccagacagcaaagttgcctgcgaaacatgcaccaatacnaacttggtcatggtcttcg

SEQ ID NO: 2284 - DNA, 284 bp, Glycine max
  unsure (1)..(284): unsure at all n locations
nangcacgcgtacgtaagctcggaattcggctcgagcagagttgagaccaagacacactcgttcatatatctctctgctcttctcttctcttctacctctcaagtttttgaagtataaagatggcagagacattcctattcacctcggagtcagtgaacgagggacaccctgataagctctgcgaccaaatctccgatgctgtcctcgacgcttgcctcgaacaggaccnnacaancaaggttgcctgngaaacatgcaccaagaccaacttggtcatggtctn

SEQ ID NO: 2285 - DNA, 208 bp, Glycine max
  unsure (1)..(208): unsure at all n locations
cangcacgcgtacgtaagctcggaattcggctcgagcattggtgtccctgagcccttgtcagtgtttgtggacacttatggaactgggaagattcctgacaaggagattctgcaaattgtgaaggagaatttcgacttcagacctggaatgatcaccattaacttggaccttaanaggggtggtcataggttcctcaagacanntgct

SEQ ID NO: 2286 - DNA, 270 bp, Glycine max
  unsure (1)..(270): unsure at all n locations
gcagacttnacaacagcacanagcgggttactgtctgttcaangctacgatctctgtctctgttatcttagtgcctaccttgccagaagnnannatggcccaatnaantttccnattcacatctgantcantgaacnatgggcaccctganaanctctgtgnccagatctccgatgctgtgctcgatgcatgcttggagcaggaccctganagcnaggttgcntgtnaaacctgnaccaagaccaacatggtgatggtnttcggagagat

SEQ ID NO: 2287 - DNA, 302 bp, Glycine max
  unsure (1)..(302): unsure at all n locations
nntcgcatgcacgcgtacgtaagctcggaattcggctcgaggntttgaggccaggcaagccccactcaaccaccacacntctcctcgttcacgctacccctttctggctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccanaaccaacntggtcatg

SEQ ID NO: 2288 - DNA, 195 bp, Glycine max
  unsure (1)..(195): unsure at all n locations
cgtaagctcggaattcggctcgagncaatgatcaaattgctgcggaccttaaagagcatgttatcaagcctgtcattcttgagaagtaccttgatgagaancaccatcttccaccttaacccttctggccgttttgtcattggtggccctcatggtgatgctggtctcactggaagaaaatcatcattgatacct

SEQ ID NO: 2289 - DNA, 314 bp, Glycine max
  unsure (1)..(314): unsure at all n locations
ngcntgtacgcgtacgtaagctcggaattcggctcgaggtcaggcaagccccactcaaccaccacacctctgcctgngttcangctacccctttntgctcttcttctacctttgaagttttaaaagtataaagatggcagagacattcctatttacctcagagtcggtgaacganggacaccctgacaagctctgcganccaaatctccgatgctgtcctcgacgnttgnctcgagnaggacccagacagnaaagttgcctgcgatanatgcaccannaccaacttggtcatggtcttcggagaaatcacgacc

SEQ ID NO: 2290 - DNA, 303 bp, Glycine max
  unsure (1)..(303): unsure at all n locations
tcgcngcacgcgtacgtaagctcggaattcggctcgagatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatggcaccaaaaccaacttggtcatggtctt

SEQ ID NO: 2291 - DNA, 285 bp, Glycine max
  unsure (1)..(285): unsure at all n locations
gtcgcatgcacgcgtacgtaagctcggaattcggctcgagcttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtnnaaacctgcaccaagaccaacatggt

SEQ ID NO: 2292 - DNA, 289 bp, Glycine max
agtcgcatgcacgcgtacgtaagctcggaattcggctcgaggcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctggcaccaagaccaacatg

SEQ ID NO: 2293 - DNA, 343 bp, Glycine max
  unsure (1)..(343): unsure at all n locations
acngcgtacgtnanctcggnattcggctcgagggccaggcaagccccactcaaccaccacacctctcctcgttcacgctacccctttctgctcttcttctacctttcaagttttaaaagtatacagatggcagagacattcctatttacctcagagtcggtgaacgagggacaccctgacaagctctgcgaccaaatctccgatgctgtcctcgacgcttgcctcgagcaggacncagacagcaaagttgcctgcgaaacatgcaccaaaaccaattggtcatggtcttcggagaaatcacgacagccangttgatagagagatatgcgtgacnctgcagaca

SEQ ID NO: 2294 - DNA, 289 bp, Glycine max
  unsure (1)..(289): unsure at all n locations
antcgnntgcacgcgtacgtaagctcggaattcggctcgaggggcaagccccactcaaccaccacacntctcctcgttcacgctacccctttctgctcttcttctacctttcaagttttaaaagtataaagatggcagagacattcctatttacctcagagtcggtgaacgagggacaccctgacancctctgcgaccaaatctccgatgctgtcctcgacgcttgcctcgagcaggacccagacagcaaagttgcctgcgaaacatgcaccanaaccaacttggtcat

SEQ ID NO: 2295 - DNA, 296 bp, Glycine max
  unsure (1)..(296): unsure at all n locations
gtcgcangcacgcgtacgtanagctcggaattcggctcgagntgaggccaggcaagccccactcaaccaccacacctctcctcgttcacgctaacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaacncacttggtc

SEQ ID NO: 2296 - DNA, 286 bp, Glycine max
  unsure (1)..(286): unsure at all n locations
agtagcangcacgcgtacgtaagctcggaattcggctcgagggcaagccccactcaaccaccacacntctcctcgttcacgctacccctttcttnctcttcttctacctttncaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttgg

SEQ ID NO: 2297 - DNA, 318 bp, Glycine max
  unsure (1)..(318): unsure at all n locations
gtcgcatgcacgcgtacgtnagctcggaattcggctcgagggccaggcaagccccactcaaccaccacacctctcctcgttcacgctacccctttctgctcttcttctacctttcaagttttaaaagtataaagatggcagngacattcctatttacctcagagtcggtgaagagggacaccctgacaagctctgcgaccaaatctccgatgctgtcctcgacgcttgcctcgagcaggacccagacagcaaagttgcctgcgaaacatgcaccagaaccaacttggtcatggtcttcggagaaatcacgaccaaggc

SEQ ID NO: 2298 - DNA, 290 bp, Glycine max
  unsure (1)..(290): unsure at all n locations
ngnngcacgcgtacgtnagctcggaattcggctcgagtttgaggccaggcaagccccactcaaccaccacacgggctcctcgttnacgctacccctttctncctcttcttctacctttcaagttttaaaagtataaaaatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaactt

SEQ ID NO: 2299 - DNA, 275 bp, Glycine max
  unsure (1)..(275): unsure at all n locations
gtcgcangcacgcgtacgtaagctcggaattcggctcgagagcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctgcac

SEQ ID NO: 2300 - DNA, 308 bp, Glycine max
  unsure (1)..(308): unsure at all n locations
ncgtcgcangcacgcgtacgtaagctcggaattcggctcgagaggcaagccccactcaaccancacanggnncctcgttnacgctacccctntctncctcttcttctacctttcagngtnttaaaagtataaagatggcagagacattcctatttaccagagtcggtgaacgagggacaccctgacaagctctgcgaccaaatctccgntgctgtcctcgacgcttgcctcgagcaggacccagacagcaaagttgcntgcgaaacatgcnccaaaaccaacttggncatggtcttcggagaaatcag

SEQ ID NO: 2301 - DNA, 300 bp, Glycine max
  unsure (1)..(300): unsure at all n locations
nngtcgangcacgcgtacgtaagctcggaattcggctcganctcgagccgattcggctcgaggccccantcaaccaccacacctctanctcgttcacgctacccctttctgctcttcttctaactttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaacttg

SEQ ID NO: 2302 - DNA, 295 bp, Glycine max
  unsure (1)..(295): unsure at all n locations
acgtcgcangcacgcgtacgtaagctcggaattcggctcgagcaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacggcttgcctcgagcaggacccagacagcaaagttgcctgcgaaacatgcancaaaaccaacttggtcatggt

SEQ ID NO: 2303 - DNA, 281 bp, Glycine max
  unsure (1)..(281): unsure at all n locations
atgcacgcgtacgtaagctcggaattcggctcgaggccatttgggagttaggttctgcacgctctgcttccagcgagtgttctttcttcgtttcaacaccttaatttgcanacgctgcttcttcngcttgagaaatggcacaagaaacctttctattcacatctgaatctgtaaacgagggtcaccccgacaagctgtgcgaccagatctctgatgcagtgctcgatgcgtgcctgaacaggaccctgacagcaaggttgcctgtgagacatgcaccaaga

SEQ ID NO: 2304 - DNA, 297 bp, Glycine max
  unsure (1)..(297): unsure at all n locations
acgtcgcangcacgcgtacgtaagctcggaattcggctcgaggggttactgtctgttcaagctaccatctctctctctctttcttagtgcctccttgccagaagttaaaatggcccaagaaactttcctattcacatctgaatcagtgaacgaggggcaccctgagaagtctgtgaccagatctccgatgctgtgctcgatgcatgnttggagcaggaccctgacagcaaggttgcctgtnaaacctgcancaagancaacatggtgatggntttncggagagatcacaaacanngc

SEQ ID NO: 2305 - DNA, 310 bp, Glycine max
  unsure (1)..(310): unsure at all n locations
gtcgcacgcacgcgtacgtnagctcggaattcggctcgagcngccactaacgtaatcaggggnacaaagnnatcacaagttcaancnacttntcnnnttcttaangggcgtccntnccagncgttaaaatggcccaagaaactttcctatncacatctgaatcagtgaacgangggcaccctgacagctctgtgaccagatctccgatgctgtgctcgntgcntgcntggagcaggaccctgacagcnaggntgcctgtgaaacctgcaccaagacnnacatggtganggttttcgganganatcacaac

SEQ ID NO: 2306 - DNA, 295 bp, Glycine max
  unsure (1)..(295): unsure at all n locations
tcgcangcacgcgtacgtaagctcggaattcggctcgagggccaggcaagccccactcaaccaccacacctctcctcgttcacgctacccctttctgctcttcttctacctttcaagttttaaaagtataaagatggcagagacattcctatttacctcagagtcggtgaacgagggacccctgacaagctctgcgaccaaatctccgatgctgtcctcgacgcttgcctcgagcaggacccagacagcaaagttgcctgcgaaacatgcaccannaccaacttggtcatggtct

SEQ ID NO: 2307 - DNA, 158 bp, Glycine max
  unsure (1)..(158): unsure at all n locations
cnagggacaccctgataagctctgcgaccaaatctccgatgctgtcctcgacgcttgcctcgaacaggactcagacagcaaggttgcctgcgaaacatgcaccaagaccaacttggtcatggtcttcggagagacaccaccaaggccaacgttgacta

SEQ ID NO: 2308 - DNA, 302 bp, Glycine max
  unsure (1)..(302): unsure at all n locations
tcaagancacgcgtacgtaagctcggaattcggctcgaggacttaacancagcacaaagngggttactgtctgttcaagctaccatctctctctctctttcttagtgcctccttgccagaagttaaaatggcccaagaaactttcctattcacatctgaatcagtgaacgaggggcaccctgacaagctctgtgancagatctccgatgctgtgctcgatgcatgcttggagcaggaccctgacagcaaggttgctgtgaaacctgcaccaagaccaacatgtgatggttttcggaanagat

SEQ ID NO: 2309 - DNA, 295 bp, Glycine max
  unsure (1)..(295): unsure at all n locations
acgtcgcatgcacncgtacgtaagctcgggaattcnnctcgagggcaagccccactcaaccaccacacctctcctcgttcacgctacnnctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgccaccaaaaccaacttggtcatggtc

SEQ ID NO: 2310 - DNA, 271 bp, Glycine max
  unsure (1)..(271): unsure at all n locations
gtcgcangcacgcgtacgtaagctcggaattcggctcgaggcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctg

SEQ ID NO: 2311 - DNA, 306 bp, Glycine max
  unsure (1)..(306): unsure at all n locations
tnacangcacgcgtacgtaagctcggaattcggctcgagggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccanaaccaattggtcatggtttcggagaatcac

SEQ ID NO: 2312 - DNA, 308 bp, Glycine max
  unsure (1)..(308): unsure at all n locations
gtcgcatgcacgcgtacgtaagctcggaattcggctcgagggccaggcaagccccactcaaccaccacacctctcctcgttcacgctacccctttctgctcttcttctacctttcaagttttaaaagtataaagatggcagagacattcctatttacctcagagnggtgaacgagggacaccctgacaagctctgcgaccaaatctccgatgctgtcctcgacgcttgcctcgagcaggacccagacagcaaagttgcctgcgaaacatgcaccanaaccaacttggtcatggtcttcggagaaatca

SEQ ID NO: 2313 - DNA, 290 bp, Glycine max
  unsure (1)..(290): unsure at all n locations
acgtcgcangcacgcgtacgtaagctcggaattcggctcgngcttgagcagacttaacaacagcacaaagcgggttactgtctgntcaagctaccatctctctctctctttcttagtgcctccttgccagaagttaaaatggcccaannaactttccnattcacatctgaatcagtgaacgaggggcaccctgacaagctctgtgaccagatctccgatgctgtgctcgangcatgcttggagcaggaccctgacagcaaggttgcctgtgaaacctgcaccaagaccaa

SEQ ID NO: 2314 - DNA, 294 bp, Glycine max
  unsure (1)..(294): unsure at all n locations
tcgcatgcacgcgtacgtaagctcggaattcnnctcgaggcaagccccactcaaccaccacacctctcctcgttcacgctacccctttctgctcttcttctacctttcaagttttaaaagtataaagatggcagagacattcctatttacctncagagtcggtgaacgagggacaccctgacaagctctgcgaccaaatctccgatgctgtcctcgacgcttgcctcgagcaggacccagacagcaaagttgcctgcgaaacatgcaccaaaaccaacttggtcatggtcttcg

SEQ ID NO: 2315 - DNA, 297 bp, Glycine max
  unsure (1)..(297): unsure at all n locations
ncgtcgcangcacgcgtacgtaagctcggaattcggctcgaggatttgaggccaggcaagccccactcaaccaccacacctctcctcgttcacgctacccctttctgctcttcttctacctttnaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaantggt

SEQ ID NO: 2316 - DNA, 233 bp, Glycine max
  unsure (1)..(233): unsure at all n locations
acagcacnaagcgggttactgtctgttcaagctaccatctctctactctctttcttagtgcntccttgctagangttanaatggcccanganactttcctattcacatctgantnagtgaacgaggggcaccctgacaagctctgtgnccagatctccgatgctgtgctcgatgcatgcntggagcaggaccctgacancaaggttgcctgtgaaacctgcaccaagaccanc

SEQ ID NO: 2317 - DNA, 288 bp, Glycine max
tcgctgcacgcgtacgtaagctcggaattcggctcgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaattggtcat

SEQ ID NO: 2318 - DNA, 304 bp, Glycine max
  unsure (1)..(304): unsure at all n locations
nncgtcgcangcacgcgtacgtaagctcggaattcggctcganactcgagccgattcggctcgagggccccactcaaccaccacacctctanctcgttcacgctaccacctttctgctcttcttctaactttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaattg

SEQ ID NO: 2319 - DNA, 305 bp, Glycine max
  unsure (1)..(305): unsure at all n locations
tcgcangcacgcgtacgtnagctcggnattcggctcgagnntttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaantggtcatggtcttcg

SEQ ID NO: 2320 - DNA, 299 bp, Glycine max
cgcatgcacgcgtacgtaagctcggaattcggctcgagggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaattggtcatggtcttcgga

SEQ ID NO: 2321 - DNA, 316 bp, Glycine max
  unsure (1)..(316): unsure at all n locations
tcgcatgcacgcgtacgtnagctcggaattcngctcgagcngctcgagcacacctctcctcgttcacgctacccctttctgctcttcttctacctttcaagttntaaaagtataaagatggcagagacattcctatttacctcagagtcggtgaacgagggacacctgacaagnctgcgaccaaactccgatgctgtcctcgacgcttgcctcgagcaggacccagacagcaaagttgcctgcgaaacatgcaccaaaaccaattggtcatggtcttcggagaaatcacgaccaggccaagttgactacgagaaga

SEQ ID NO: 2322 - DNA, 288 bp, Glycine max
  unsure (1)..(288): unsure at all n locations
gtcgcangcacgcgtacgtaagctcggaattcggctcgaggagccatttgggagttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagctgtgcgaccagatctctgatgagtgctcgatgcgtgccttgaacaggaccctgacagcaaggttgcctgtgagacatgcaccaaga

SEQ ID NO: 2323 - DNA, 299 bp, Glycine max
  unsure (1)..(299): unsure at all n locations
gtngcangcacgcgtacgtaagctcggaattcngctcgaggcaagccccactcaagcagcacanctctcctcgttcacgctaccccttnctgctcttcttctacctttcaagttttaaaagtataaagatggcagagacattnctatttacctcagagtcggtgaacgagggacaccctgacaagctctgcgaccaaatctccgatgntgtcctcgaatgnaaatcgagcaggacccaganagcaaagttgnctgcganacatgcaccaaaaccaacttggtcatggtcttcggagaaa

SEQ ID NO: 2324 - DNA, 254 bp, Glycine max
  unsure (1)..(254): unsure at all n locations
caacagcacaaagcgggttactgtctgttcaagctaccatctctctctctctttgcttagtgcctccttgccagaagttaaaatggcccaagaaactttcctattcacatctgaatcagtgaacgaggggcacccgacaagctctgtgaccagatctccgatgctgtgctcgatgcatgcttggagcaggaccctgacagcaaggttgcctgtgaaacctngcaccaagaccnacatggtgatggttttcggag

SEQ ID NO: 2325 - DNA, 227 bp, Glycine max
  unsure (1)..(227): unsure at all n locations
cacgcgtacgtaagctcggaattcggctcgannttctcaacattgtgaaggaaaactttgatttcaggcctggtatgatctccatccaaccttgatctcaagaggggtggaaataacaggtttttgaagactgctgcctatggacactttggaagagaagaccctgacnttcacatggggaagttggtccnaccccntcnagttgggnaaagccnaaccatttcatc

SEQ ID NO: 2326 - DNA, 294 bp, Glycine max
  unsure (1)..(294): unsure at all n locations
gtcatgnaggacgnangacgtgnagctcagnattcggntcgagcgttcacgctaacccctttctggctctncttcnanctttcaagttttaaaagtatanagatgngcagaganattcctatttacctacagagtcggtnaacgagggacaccctgacaagctctgcgaccaaatcccgatgctntcctcgacgcttgcctcgagcnggacccagacagcaaagttgcctgcgaaacatgcaccaaaaccaacttggtcatggtcttcggaganntcangaccaaggccaacgt

SEQ ID NO: 2327 - DNA, 281 bp, Glycine max
  unsure (1)..(281): unsure at all n locations
cgtcgcatgcacgcgtacgtaagctcggaattcggctcgaggngggttactgtctgtncaanctaccatctctctctctctntcttagtgcctcccgtgncagnngtnanaatggcccaanaaactttcctattnacatctgaatcagtgaacgangggcanccganaanctccgtgaccagatntccgatgctgtgntcgatgcatgcttggagcaggaccctgacagcaaggttgcctgtganacctgcaccaagaccancatggtgntggtttncgga

SEQ ID NO: 2328 - DNA, 294 bp, Glycine max
  unsure (1)..(294): unsure at all n locations
tacgttncncgcgtacgtaagctcggaattcggctcgagaacagnacaaagcgggttactgtctgttcaagctaccatcctctctctctcnttcttagtgcctcctnncnanaagttaaaatggcccannanactttcctatncacatctgaatcantgaacgaggggcacnctgacaagntctgtgnccagatctccggtgctgtgctcgatgcatgcttggagcaggaccctgacagcaaggntgcctggaaacctgcacnaagaccaacatggtgatngntttcggagann

SEQ ID NO: 2329 - DNA, 284 bp, Glycine max
  unsure (1)..(284): unsure at all n locations
gntgcatgcacgcgtacgtaagctcggaattcggctcgagtgaggccaggcaagccccactcaaccaccacacctctcctcgttcacgctacccctttctgctacttcttctacctttcaagttttaaaagtataaagatggcagagacattcctatttacctcagagtcggtgaacgagggacaccctgacangctctgcgaccaaatctccgatgctgtcctcgacgcttgcctcgagcaggacccagacagcaaagttgcctgcgaaacatgcaccaaaac

SEQ ID NO: 2330 - DNA, 282 bp, Glycine max
  unsure (1)..(282): unsure at all n locations
naacgcangcacgcgtacgtaagctcggaattcggctcgagggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaacc

SEQ ID NO: 2331 - DNA, 309 bp, Glycine max
  unsure (1)..(309): unsure at all n locations
angtcgcangcacgcgtacgtaagctcggaattcggctcgnnctcgagccgaatnggctcgagcacaaagcgggntactgncngntacaagctacnatctctcncctctctntcttagtgnctacctgccagangtnaaaatggccnaagaaactntnctattnnnatctgnttcagtgaacgaggggcacnctgacaanntctttgacgagatctccgatgctgtgntcgatgcatgcttggagcaggaccctgacagcaaggttgcctgtnaaacctgcncnaanancaacatggtgatggtttcgg

SEQ ID NO: 2332 - DNA, 262 bp, Glycine max
  unsure (1)..(262): unsure at all n locations
ggccaggcaagccccactcaaccaccacacaagtcntcgtcacacgctgacccctttctggtnttnttgtanntttcaagntttaaaagtataaagatggcagagacattcctatttacctcagagtcggtgaacgagggacaccctgacaagctntgcgaccaaatctccgatgctgtcctcgacgcttgcctcgagcaggacccagacagcaaagttgcnngcgaaacatggcaccaaaaccaattggtcatggtnttcg

SEQ ID NO: 2333 - DNA, 296 bp, Glycine max
  unsure (1)..(296): unsure at all n locations
tngtctcatgcacgcgtacgtaagctcggaattcggctcganctcganccgnttcggctactagaagccccactcaaccancacacctcncnctcgttcangctacccctttctgctcttcttctaccttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaac

SEQ ID NO: 2334 - DNA, 291 bp, Glycine max
  unsure (1)..(291): unsure at all n locations
tngtcgcangcacgcgtacgtaagctcggaattcggctcgnnctcgagccgattcggctcgagcaacagcacaaagcgggttactgtnngttcaagctaccatctctactctctctntcttagagcctccttgccagaagttaaaatggcccaagaaactttcctattcacatctgaatcagtgancgaggggcaccctgacaagctctgtgaccagatctccgatgctgtgctcgatgcatgcttggagcaggaccctgacagcaaggttgcctgtgaaacctgcaccaa

SEQ ID NO: 2335 - DNA, 271 bp, Glycine max
  unsure (1)..(271): unsure at all n locations
cgtcgttgcacgcgtacgtaagctcggaattcggctcgcnagctccactcaaccaccacacntctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaac

SEQ ID NO: 2336 - DNA, 284 bp, Glycine max
  unsure (1)..(284): unsure at all n locations
gtcgcangcacgcgtacgtaagctcggaattcggctcgagggccaggcaagccccactcaaccaccacactggctcctcgtttncgctacccctttctncctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaacca

SEQ ID NO: 2337 - DNA, 303 bp, Glycine max
  unsure (1)..(303): unsure at all n locations
ncgtcgcangcacncgtacgtaagctcggaattcggctcgnnctcgagccgattcggctcgagcaagccccactgcaaccaccacaacntcttcctcgttcacgactacccctttctgctcttcactctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaacca

SEQ ID NO: 2338 - DNA, 183 bp, Glycine max
  unsure (1)..(183): unsure at all n locations
tcgcatgcacgcgtacgtnagctcggaattcggctcgagtgaaacccctgagtacatgcccctcagccatgtccttgcaaccaaactcggtgctcgcctcaccgaggttaggaaaaatggtacctgtgcttggctgaggccagatggcaagacacaagtaactgttgagtactacaatgacaa

SEQ ID NO: 2339 - DNA, 322 bp, Glycine max
  unsure (1)..(322): unsure at all n locations
gcatgcagcgtacgtaagctcgggaattcngctcganggctgcgagaagacgacagaagggggcagcgcttgatttgaggccaggcaagccccactcaaccaccacacctctcctcgttcacgctacncctttctgntcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcccgcgaaacatgcaccaaaaccaac

SEQ ID NO: 2340 - DNA, 259 bp, Glycine max
  unsure (1)..(259): unsure at all n locations
tcgcangcacngngtacgtnagctcggaattcggctcgagganagcacaaagcgggttacngtctgtncaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacct

SEQ ID NO: 2341 - DNA, 309 bp, Glycine max
  unsure (1)..(309): unsure at all n locations
ncgcatgcacgcgtacgtaagctcggnattcngctcgnnctcgagccgattcggctcgagaaacgagccatttggnagtnaggtncctgcacgntctgcttacccgcnagtgttctttcttcacttcaacaccttaatttncacacgctgcttcttcngcttgaganatggcacaagaaacntttctattcacatctgaatctgtaaacganggtcaccccgacaagctgtgcgaccagatctctgatgcagtgctcgatgcgtgccttgaacaggaccctgacagcaaggttncctgtnagacatgcn

SEQ ID NO: 2342 - DNA, 277 bp, Glycine max
  unsure (1)..(277): unsure at all n locations
cgtgcagcgtacgtaagctcggaattcggctcgagcagacttaacaacagcacnaagcgggttantgtctgttcaagctaccatctctctctctntttcttagtgcctccttgccagangttaaaatggcccaanaaactttcctnttcacatctgaatcagtgaacgaggggcaccctgacaagntctgtgaccagatctccgntgctgtgctcgatgcatgcttggagcaggaccctgacancaaggttgcctgtganacctgcaccaagaccaa

SEQ ID NO: 2343 - DNA, 287 bp, Glycine max
  unsure (1)..(287): unsure at all n locations
gtcgcangcacgcgtacgtnagctcggnattcggctcgaggnggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcttcgacgcttgcctcgagcaggacccagacagcaaagttgcctgcgaaacatgcaccaaanccaact

SEQ ID NO: 2344 - DNA, 321 bp, Glycine max
  unsure (1)..(321): unsure at all n locations
cacgcgtacgtaagctcggaattcngctcgaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaattggtcatgntcttcggagaaatcacgaccaggccaagntgactacgagaag

SEQ ID NO: 2345 - DNA, 303 bp, Glycine max
  unsure (1)..(303): unsure at all n locations
ngtcgcangcacgcgtacgtnagctcggnattcggctcgnnntcgagccgaatcggctcgagcaaagaccccactcaaccaccaancctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaaccaattg

SEQ ID NO: 2346 - DNA, 307 bp, Glycine max
  unsure (1)..(307): unsure at all n locations
tcgcangcacgcgtacgtaagctcggaattcggctcgagctcnagccggtgatttggagtttggagcgactgaactaatcattaatttgcactccgctgtttcagcttcatcacccttcttttgcatcatttatatctcttgagaaatggcacaagaaacctttctattcacatctgaatctgtaaacganggtcaccccgacangctgtncnancagatctctgatgcagtacttgatgcgtgcctgancaggaccctgacagcaaggttgcctgtgagacatgcaccaagaccaantggtcatgg

SEQ ID NO: 2347 - DNA, 316 bp, Glycine max
  unsure (1)..(316): unsure at all n locations
gtcnctgcacgcgtacgtaagctcggaatcggctcgannctcgagccgaatcggctcgagaacagcacaaagcgggttactgtcacttcaagctaccatctatctctntnctttcttagtgcntccttggccanaagttaaaatggcccaagaaactttcctattcacatctgaatcagtgaacgaggggcaccctgacaagctctgtgaccagatctccgatgctgtgctcgatggcatgcttggagcaggaccctgacagcaaggtttnctgtgnaaacntggtaccaagaccaacatggtgatggttttcggn

SEQ ID NO: 2348 - DNA, 281 bp, Glycine max
  unsure (1)..(281): unsure at all n locations
gtcgcatgcacgcgtacgtaagctcggaattcggctcgaggccccactcaaccaccacaccactctctctgctcttcttctacctttcaagtttttaaagtattaagatggcagagacattcctatttacctcagagtcagtgaacgagggacaccctgacagctctgcgaccaaatctccgatgctgtcctcgacgcttgccttgaacaggacccagacancaaggttgcctgcgaaacatggcaccaagaccaattggtcatggtcttcggagagatca

SEQ ID NO: 2349 - DNA, 295 bp, Glycine max
  unsure (1)..(295): unsure at all n locations
aaagtcgcangcacgcgtacgtaagctcggaattcggctcgagcactcaaccaccacacctctcctcgttcacgctacccntttctgnctncttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctggcgaaacatgcaccaaaaccaacttggtccatggtcttcgga

SEQ ID NO: 2350 - DNA, 491 bp, Glycine max
  unsure (1)..(491): unsure at all n locations
tttacttnncccgnccggtacaagtcataaattcccgggncgacccacgcntccnnccacgcgtccgtacggctgcgagaagacgacagaagggggcagcgcttgatttgaggccaggcaagccccactcaaccaccacacctctcctcgttcacgctacccctttctgctcttcttctacctttcaagttttaaaagtataaagatggcaganacattcctatttacctcanagtcggtgaacgagggacnccctgacaagctctgcgaccaaatctccgatgctgtcctcgacgcttgccncgatcaggacccagacagcaaanttgcctgcaaaacatgcaccaaaaaccaacttggtcatggtcttcggagaaatcangaccaaangccaacgtngactacngaagaanaatagtgcgttnacacctngcaggaacatcgngcttcgtctcaaaatgatttgnggactggattcncnaacaactggg

SEQ ID NO: 2351 - DNA, 276 bp, Glycine max
  unsure (1)..(276): unsure at all n locations
gtcgnangangcacgcgtacgtnagctcggaattcggctcgagncagcacaaagcgggttacngtctgttcaagctaccanctctctctctctttcttagtgcctccttgccagangttaaaatggcccaagaaacttncctanncacatctgaatcagtgaacgaggggcaccctgacaagctcngtgaccagatcnccgatnctgtgcncgatgcatgcttggagcaggaccctgacagcaaggtngcctgtgaaanctgcaccaagancaact

SEQ ID NO: 2352 - DNA, 315 bp, Glycine max
  unsure (1)..(315): unsure at all n locations
anggngnngcacgcgtacgtaagctcggaattcggctcgagnggcnagccccactcaaccaccacacctctcctcgttcangctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagagagcaaggttgcntgcgaaacangcaccnaaaancaanttggtnatggtccttcggngattcacgaccang

SEQ ID NO: 2353 - DNA, 287 bp, Glycine max
  unsure (1)..(287): unsure at all n locations
gccnangcacgcgtacgtaagctcggaattcggctcgagtgatttgangctaggcaagccccantcaaccaccacacctctcctcgttcacgctacccctttctgctcttcttctacatttcnagttttaaaagtataaagatggcagagacattcctatttacctcagagtcggtgaacgtnggacaccctgacaagctctgcgaccaaatctccgatgctgtcctcgacgcttgcctcgagcaggacccagacagcaaagttgcctgcgaaacatgcaccaaaac

SEQ ID NO: 2354 - DNA, 277 bp, Glycine max
  unsure (1)..(277): unsure at all n locations
agtcgcangcacgcgtacgtaagctcgganttcngctcgagggcaagccncactcaaccacnacacntctcctcgttncacgctacccctttgctnctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgatacatgcaccaaaa

SEQ ID NO: 2355 - DNA, 306 bp, Glycine max
  unsure (1)..(306): unsure at all n locations
cnntcaacnngnanagtcgcangcacgcgtacgtaagctcggaattcggctcgaggcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtgaaacctggaaccaaggnccantttgnn

SEQ ID NO: 2356 - DNA, 285 bp, Glycine max
  unsure (1)..(285): unsure at all n locations
tcgcangcacgcgtacgtaagctcggaattcggctcgagtgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgncgcttgcctcgagcaggacccagacagcaaagttgcctgcgaaacatgcaccaaaancaa

SEQ ID NO: 2357 - DNA, 298 bp, Glycine max
  unsure (1)..(298): unsure at all n locations
nagtcgcangcacgcgtacgtaagctcggaattcggctcgagttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaacatgcaccaaaacaacttggtcatg

SEQ ID NO: 2358 - DNA, 288 bp, Glycine max
  unsure (1)..(288): unsure at all n locations
gtngcangcacgcgtacgtaagctcggaattcggctcgagnttgaggccaggcaagccccantcaaccaccanacacnctcctcgtnnatggctacccctttctnnctcttcttgctacctttncaagtttnaaaagtataaagatggcaganacattcctatttacctcagagtcggtnaacgagggacaccctgacaagctctgcgaccaaatctccgatgctgtcctcgacgcttgcctcgagcaggacccagacagcaaagttgcntgcgaaacatgcaccaan

SEQ ID NO: 2359 - DNA, 335 bp, Glycine max
  unsure (1)..(335): unsure at all n locations
tcgcatgcacgcgtacgtaagctcggaattcngctcgaggcaagccccactcaaccaccacacctctcctcgttcacgctacccctttctgctcttcttctacctttcaagttttaaaagtatanagatggcagagacattcctatttacctcagagtcggtgaacgnggngacaccctgacaagctctgcgaccaaatctccgatgctgtcctcgacgcttgcctcgagcaggacccagacagcaaagttgcctgcgaaacatgcaccaaaaccaacttggtcatggtcttcggagaaatcacgaccaagccaagttgactagaagaagatatg

SEQ ID NO: 2360 - DNA, 505 bp, Glycine max
  unsure (1)..(505): unsure at all n locations
ttcnaactttcaccgcccaggtaacngtanaagaattcccggnccgacccacgngtcancccangcgtccgcccacgcgtccgtacggctgcnanaagacgacagaangggcaccgcttgagcagacttaacaacatnacaaaccgggttactgtctgttcanggctaccatctctctctctctttcttaggtgnctccttgccagnangtnnnaatgnggcnaagnaacttncctattcacatctgantcagtgaacgatgggnaccntgacaagctctgtgaccagatcnccgatgcngtgctcgatgcangcttggagcaggaccctgacagcnncgttgcctgtgaaacctgcaccaataccancatggtgatgggttttcggagagatnccaancgangccnaannttgnaactattaggaagattngnggcgntgacncatncaggaananttnctttgncgccnngntnatggntgctcctgnnggcnganaancttc

SEQ ID NO: 2361 - DNA, 283 bp, Glycine max
  unsure (1)..(283): unsure at all n locations
acgtcgcangcacgcgtacgtaagctcggaattcggctcgaggcagacttaacaacagcacanagcgggttactgtctgttcaagctaccatctctctctctctttcttagtgcctccttgccagaagttaaaatggcccaagaanctttcctattcacatctgaatcagtgaacgaggggcaccctgacaagctctgtgaccagatctccgatgctgtgtcgatgcatgcttggagcaggaccctgacagcaaggttgcctgtgaaacctgcaccaagacca

SEQ ID NO: 2362 - DNA, 495 bp, Glycine max
  unsure (1)..(495): unsure at all n locations
tttacnagctcttacgcggncaantaccgtgtntaggnattcccgggctcgacncacgcgtcagtacggctgcgagaagngaacnnagggggcaacacntggnttgangncatgcaagccccactcaaccaccacacctcncctcgttcacgctacccctttctgctcttcttctanctttcatnttttaanncgtatanagatggcanagacattcctatttacntcagngtcagtgaacganggacacnctgacaagctctgcgagcaaatctccagntgctgtcctcgacgcttgcctcgancaggacccatacagcaaacttgcctgccaancatgctccaaaaccancttggtcntngtcttcgganaaatcncnaccaaggccaacnttgactncnanangatantgcgttacactgcnggaacatnggcttcttctcatatgatntgggactggattccnacncctgcaaagtccttcgtcaacattt

SEQ ID NO: 2363 - DNA, 266 bp, Glycine max
  unsure (1)..(266): unsure at all n locations
gttgcatgcacgcgtacgtaagctcggaattcngctcgagaacagcacnaagcgggttactgtctgttcaagctaccatctctctctctctttcttagtgcctccttgccagaagttaaaatggcccaagaaactttcctattcacatctgaatcagtgaacgagggcaccctgacaagctctgtgaccagatctccgatgctgtgctcgatgcatgcttggagcaggaccctgacagcaaggttgcctgtgaaacctgcaccaag

SEQ ID NO: 2364 - DNA, 286 bp, Glycine max
  unsure (1)..(286): unsure at all n locations
agtcactgcacgcgtagtaagctcggaattcggctcganctcgagccgattcggctcgagggcagacttaacaacagcacaaacgcgggttactgtctgntcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctgtg

SEQ ID NO: 2365 - DNA, 299 bp, Glycine max
  unsure (1)..(299): unsure at all n locations
tcgcacgcacgcgtacgtnagctcggaattcggctcgaggcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaagttggcctgtgaaacctgcaccangngtgacatggtgatggtttcg

SEQ ID NO: 2366 - DNA, 316 bp, Glycine max
  unsure (1)..(316): unsure at all n locations
naaaanaanggaaantcgcatgcacgcgtacgtnagctcggaattcggctcgagggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaactgcaccanaaccaattggtcatggtcttcggaga

SEQ ID NO: 2367 - DNA, 289 bp, Glycine max
  unsure (1)..(289): unsure at all n locations
gtcgcngcacgcgtacgtgagctcggaattcggctcgagggccaggcaagccccactcaaccaccacacctctcctcgttcacgctacccctttctgctcttcttctacctttacaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaactgcaccancaccaattggtca

SEQ ID NO: 2368 - DNA, 302 bp, Glycine max
  unsure (1)..(302): unsure at all n locations
gtcgcangcacgcgtacgtnagctcggaattcggctcgagggccaggcaagccccactcaaccaccacacctctcctcgttcacgctacccctttctgctcttcttctacctttcaagttttaaaagtataaagatggcagagacattcctatttacctcagagtcggtaacgagggacaccctgacaagctctgcgaccaaatctccgatgctgtcctcgacgcttgcctcgagcaggacccagacagcaaagttgcctgcgaaacatgcaccataaccaacttggtcatggtcttcggag

SEQ ID NO: 2369 - DNA, 288 bp, Glycine max
  unsure (1)..(288): unsure at all n locations
cgcatgcacgcgtacgtnagctcggaattcggctcgagtttgaggccaggcaagcnccactcaaccaccacacctctcctcgttcacgctacccctttctgctacttacttctacctttcaagttttaaaagtataaagatggcagagacattcctatttacctannagccggtgaacgagggacaccctgacaagctctgcgaccaaatctccgatgctgtcctcgacgcttgcctcgagcaggacccagacagcaaagttgcctgcgaaacatgcaccaaaacnaa

SEQ ID NO: 2370 - DNA, 292 bp, Glycine max
  unsure (1)..(292): unsure at all n locations
cgcangcacgcgtacgtaagctcggaattcngctcgagcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaactgcaccaaaaccaatgggtcangntctnagaaa

SEQ ID NO: 2371 - DNA, 288 bp, Glycine max
  unsure (1)..(288): unsure at all n locations
gtcgcngcacgcgtacgtaagctcggnattcngctcgaggcaagccccactcaaccaccacacctctacctacgttcacgctacccctttctgctcttcttctacctttacaagttttaaaagtataaagatggcagagacattcctatttacctacagagtcggtgaacgagggacaccctgacaagctctgcgaccaaatctccgatgctgtcctcgacgcttgcctcgagcaggacccagacagcaaagttgcctgcgaaacatgcaccaaaaccaacttggtca

SEQ ID NO: 2372 - DNA, 299 bp, Glycine max
  unsure (1)..(299): unsure at all n locations
acgtcgctgcacgcgtacgtaagctcggaattcggctcgaggtgatttggagtttggagcgactgaactantcattaatttgcacttcgctgtttcagcttcatcacccttcttttgcatcatttatatctcttgagaaatggcacaagaaacctttctattcacatctgaatctgtaaaccanggtcaccccgacaagctgtgcgaccagatctctgatgcagtacttgatgcntgcctgnncaggaccctggacagcnaggtancctgtnagacatgcaccaagaccaacatggtca

SEQ ID NO: 2373 - DNA, 283 bp, Glycine max
  unsure (1)..(283): unsure at all n locations
cgcatgcacgcgtacgtnagctcggaattcggctcgagggcaagccccactcaaccaccacacctctcctcgttcacgctacccctttctgctcttcttctacctttcaagttttaaaagtataaagatggcagagacattcctatttacctcagantcggtgancgagggncaccctgacaagctctgcgaccaaatctccgatgctgtcctcgacgctngcctcgancaggacccanacagcnaagttgcctncganacatgnaccaaaaccaacttggtc

SEQ ID NO: 2374 - DNA, 283 bp, Glycine max
  unsure (1)..(283): unsure at all n locations
gannagtcgcangcacgcgtacgtaagctcggaattcggctcgagnnacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctntgctcgatgcatgcttggagcaggaccctgacagcaaggttgcctgtgaaaactgcaaccaagaccaannat

SEQ ID NO: 2375 - DNA, 302 bp, Glycine max
  unsure (1)..(302): unsure at all n locations
nanncgcangcacgcgtacgtaagctcggaattcggctcgagctcgagccgtggagtttggagcgactgaactaatcattaatttgcactncgctgtttcagcttcatcacccttcttttgcatcatttatatctcttgagaaatggcacaagaaacctttctattcacatctgaatctgtaaacnagggtcaccccgacaagctgtncnaccagatctctgatgcagtacttgatgcgngcctgancaggaccctgacagcaaggttgcctgtgagacatgcaccaagncccaacatggtc

SEQ ID NO: 2376 - DNA, 270 bp, Glycine max
  unsure (1)..(270): unsure at all n locations
gcanngtnacgtaagctncggaattcggctcgaggacttaacaacagcacaaagcgggttactgtgctgttcaagctaccatctctctctctctttcttagtgcctccttgccagaagttaaaatggcccaagaaactttcctattcacatctgaatcagtgaacgaggggcaccctgaacaagctctgtgaccagatctccgatgctgtgctcgatgcatgcttggagcaggaccctgacagcaaggttgcctgtganacctgcaccaa

SEQ ID NO: 2377 - DNA, 312 bp, Glycine max
  unsure (1)..(312): unsure at all n locations
ngtcgcangcacgcgtacgtaagctcggaattcggctcgagagaccaagccccactcaaccancacaccantctactctgctcttcttctacctttcaagtttctaaagtatnaagatggcagagacattcctattnacctcagagtcagtgaacnagggacaccctgatcaagctctgcgagccanatctccgatgctgtcctcgacggcttgccttgaacaggacccagacagcaaggttgcctgcgaaacatgcaccaagaccaacttggtcatggtcttcggagagatcaccnccaaggccaacgttg

SEQ ID NO: 2378 - DNA, 328 bp, Glycine max
  unsure (1)..(328): unsure at all n locations
agtcgcatgcacncgtacgtaagctcggaatttcggctcgaggcattgtggcaagtggactagccagaaggtgcancncngcaagtgtcttatgccattggtgtgcncgancctttgtnctgtatttgttgacacctatggcaccgggaagatccatgataaggagattctcaacattgtgaaggagaacttgatttcanncccggtatgatctcccatcaaccttgatntcaagaggggtgggaataacaggttcttgaagatgctgcatatggacattcggcagagagncgnattcacaggggatggtcnangcccccccaatggg

SEQ ID NO: 2379 - DNA, 258 bp, Glycine max
  unsure (1)..(258): unsure at all n locations
cagcacaangcgngttacngncnngtcaagcnaccatctctctctctctttnttagtggcctccttgccagaagttaaaatngcccaagaaactttcntattcacatctnaanccagtnaacgaggggcaccctgacaagctctgtgancagatcnccgatgcngtgctcgntgcatnnttggagcangaccctgacagcaaggttgcctgtgaaacctgnaccaanaccaacatggngangggttcggagagatcac

SEQ ID NO: 2380 - DNA, 267 bp, Glycine max
  unsure (1)..(267): unsure at all n locations
gtcgcanangangcgnacgtncagctcggaattcggctcgaggtccggtatgatctccatcaaccttngatctcaagaggggtgggaataacaggttcttgaagactgctgcatatggacacttcggcagagaggaccctgacttcacatgggaagtggtcaagcccctcaagtgggaganggcctaaggccattcattccacngcaatgtgctgggagtttttnagcgttgcccttataatgnctattatccataactttccacgt

SEQ ID NO: 2381 - DNA, 311 bp, Glycine max
  unsure (1)..(311): unsure at all n locations
agtcnnatnaacgcgtacgtaagctcggaattcggctcgagtacggctgcnagaagacgacagaagggggcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaa

SEQ ID NO: 2382 - DNA, 235 bp, Glycine max
  unsure (1)..(235): unsure at all n locations
tttgaggccaggcaagccccactcaaccaccacacctctcctcgttcacgctacccctttactgctctncttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgcgaaaca

SEQ ID NO: 2383 - DNA, 168 bp, Glycine max
  unsure (1)..(168): unsure at all n locations
ncngcncgngtacgngtacgcnagctcggaattcggctcgaggtgctggtgaccagggtcacatgtttggctatgccactgatgaaacccctgaattgatgccattgagccatgttcttgcaacaaaactcggtgctcgtctcaccgaggttcgnaagaacggtacct

SEQ ID NO: 2384 - DNA, 156 bp, Glycine max
tagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggttgcctg

SEQ ID NO: 2385 - DNA, 278 bp, Glycine max
  unsure (1)..(278): unsure at all n locations
ggccaggcaagccccactcaaccaccacacctctcctcgttcacgctacncctttctgctcttcttctacntttcaagttttaaaagtataaagatggcagagacattncctatttacctcanagtcggtgaacgagggacaccctgacaagctctgcgaccaaatctccgatgctgtcctcgacgcttgcctcgagcaggactcagacagcaaagttgcctgcgaaacatggcaccaanaccaattggtcatggtcttcggagaatcacgnccaagg

SEQ ID NO: 2386 - DNA, 278 bp, Glycine max
  unsure (1)..(278): unsure at all n locations
gtcgcangcacgcgtacgtnagctcggnattcggctcgagggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtccttcgacgcttgcctcgagcaggacccagacagcaaagttgcctgcgaaacatgcaccaa

SEQ ID NO: 2387 - DNA, 309 bp, Glycine max
  unsure (1)..(309): unsure at all n locations
nngtcgcangcacgcgtacgtaagctcggaattcggctcgagtacggctgcnagaagacgacagaagggggcagcgcttgatttgaggccaggcaagccccactcaaccaccacacctctcctgcgttcagctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcctgc

SEQ ID NO: 2388 - DNA, 219 bp, Glycine max
gctcggaattcggctcgagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatgcatgcttggagcaggaccctgacagcaaggt

SEQ ID NO: 2389 - DNA, 314 bp, Glycine max
  unsure (1)..(314): unsure at all n locations
gngtacgtnagctcggaattcggctccgagngatttgaggccaggcaagccccactcaaccaccacacntctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcnaagttgcctgcgaaactgcaccaaaaccaatnggtcaggtcttcgggaatcngacaagccacgt

SEQ ID NO: 2390 - DNA, 287 bp, Glycine max
  unsure (1)..(287): unsure at all n locations
ggaannntcgcangcacgcgtacgtnagctcggaattcggctcgagnacttaacaacagcacaaagcgggttactgtctgttcaagctaccatctctctctctctttcttagtgcctccttgccagaagttaaaatggcccaagaaactttcctattcacatctgaatcagtgaacgaggggcacctgacaagctctgtgaccagatctccgatgctgtgctcgatgcatgttggagcaggacctgacagcaaggttgcctgtgaaacctgcaccaagaccaanatg

SEQ ID NO: 2391 - DNA, 281 bp, Glycine max
  unsure (1)..(281): unsure at all n locations
annantcgcangcacgcgtacgtnagctcggaattcngctcgagggccaggcnagccccactcaaccaccacacnactcctcnttcncgctaccccttttctgcncntcttctacctttcaagttttaaaagtatanagatggcagagacattcctatttacctcagagtcggtgaacgagggacaccctgacaagctctgcgaccaaatctccgatgctgtgcttcgacgcttgcctcgagcaggacncagacagcaaagttgcctgcgaaacatgcacc

SEQ ID NO: 2392 - DNA, 275 bp, Glycine max
  unsure (1)..(275): unsure at all n locations
gtcgcatgcacgcgtacgtaagctcggaattcggctcgagcaggcaagccccactcaaccaccacacctctcctcgttcacgctacccctttctgctcttcttctacctttcaagttttaaaagtataaagatggcagagacattcctatttacctcagagtcggtgaacgaggacaccctgacaagctctgcgaccaaatctccgatgctgtcctcgacgcttgcntcgagcaggacccagacagcaaagttgcctgcgaaacatgcagcaaaa

SEQ ID NO: 2393 - DNA, 303 bp, Glycine max
  unsure (1)..(303): unsure at all n locations
tcgcatgcacgcgtacgtaagctcggaattcggctcgagtacggctgcgagaagaccacagaagggggcagcgcttgagaccaagccccactcaaccaccacaccactctctctgctcttcttctacctttcaagtttttaaagtattaagatggcagagacattcctatttacctcagagtcagtgaacgagggacaccctgacaagctctgcgaccaaatctccgatgctgtcctcgacgcttgccttgaacaggacccagacagcaaggttgctggaaacatgnanaagnccatntgggt

SEQ ID NO: 2394 - DNA, 189 bp, Glycine max
  unsure (1)..(189): unsure at all n locations
cgtaagctcggaattcggctcgaggtttcaacaccttaatttgcacacgctgcttcttcagcttgagaaatggcacaaganacctttctattcacatctgaatctgtaaacgagggtcaccccgacaagctgtgcgaccagatctctgatgcagtgctcgatgcgtgccttgaacaggaccctgacagc

SEQ ID NO: 2395 - DNA, 183 bp, Glycine max
gctgcacgcgtacgtaagctcggaattcggctcgagctcaagtttttgaagtatagagatggcagagacattcctatttacctcagagtcagtgaacgagggacaccctgacaagctctgtgaccaaatctctgatgctgtcctcgacgcttgcctcgaacaggacccagacagcaaggttgc

SEQ ID NO: 2396 - DNA, 292 bp, Glycine max
  unsure (1)..(292): unsure at all n locations
gtcgcangcacgcgtacgtnnagctcggnattcggctcgnccctcgagccgaattcggctcgagcaagccccactcaaccaccacaccnctcctcgttcacgcacncccctttctgctcttcttccacctttcaagttttaaaagtataaagatggcagagacattccttttacctcagagtcggtgaacgagggacaccctgacaagctctgcgaccaaatctccgatgctgtcctcgacgcttgcctcgagcaggacccagacagcaaagttgcctgcgaaacatgcacc

SEQ ID NO: 2397 - DNA, 271 bp, Glycine max
  unsure (1)..(271): unsure at all n locations
gtcgcangcacgcgtacgtnagctcggnaattcggctcgagngatttgaggccaggcaagccccactacaaccaccacacctctcctacgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaagttgcc

SEQ ID NO: 2398 - DNA, 287 bp, Glycine max
  unsure (1)..(287): unsure at all n locations
cncgcgtacgtaagctcggaattcgnctcgaggcagactttcacaacagcacaaagcgggttactgtctgttcaagctaccatctcgctctcgctttcttagtgcctccttggccanaagtnaaaatggcccaagaaacttncctattcacatctgaatcagtgaacgaggggcaccctgacaagctctgtgaccagatctccgatgctgtgctcgatgcatgtcttggagcaggaccctgacancaaggttgcctgtgaaactgcaccaagaccaacatggtgatg

SEQ ID NO: 2399 - DNA, 307 bp, Glycine max
  unsure (1)..(307): unsure at all n locations
gcangcncgcgtncgtgagctcggnnttnggctcgngggccaggcaagcnccactcanccaccacacctctnctcgttcacgctacccctttctgctcttcttctacctttcangttttaanagtataaagntggcagagacnttcctntttncctcagagtcggtgaacgagggacaccctgacaagctctgcgaccaaatctccgatgctgtcctcgacgcttgcgtcgagnanggaccnagacngcaagttgcctgggaaacatgcaccaggaccaatttggtaatggtctcgggaaaatcgng

SEQ ID NO: 2400 - DNA, 291 bp, Glycine max
  unsure (1)..(291): unsure at all n locations
ngtcgctgcacgcgtacgtaagctcggaattcggctcgaggacttaacaacagcacaaagcgggttactgtctgttcaagctaccatctctctctctctttcttagtgcctccttgccagaagttaaaatggcccaagaaactttcctattcacatctgaatcagtgaacgaggggnaccctganaagctcngngacnngnnntcngngntgngnncngngnangctngagganggccctnacagcaaggttgcctgtgaaacctgcaccaagaccaacatggtgatggtt

SEQ ID NO: 2401 - DNA, 304 bp, Glycine max
  unsure (1)..(304): unsure at all n locations
agtcgcangcacgcgtacgtaagctcggaattcggctcgagggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgacccaaatctccgatgctgtcctcgacgcttgncctcgagcaggacccagacagcaaagttgcctgcgaaacatgcaccaaaaccaacttggtcatggtcttcgg

SEQ ID NO: 2402 - DNA, 302 bp, Glycine max
  unsure (1)..(302): unsure at all n locations
anncangngtacgtnagctcggaattcgggtcgagnacnacagnacaatgcgggttactgtctgttcaagctaccatctactctctcactttcttacngcctccttggccagaagttaaaatgacccaagaatctttcctagtcacatctgaatcagcgaacgaggngcaccctgacaagctccgtgaccagatctccgatgctgtgcccgatgcatncttggagcaggacccnacagcaagtttgcctgttaaacctgtnccaagaccaacatggtgatggtttgggaaanatcacaaccn

SEQ ID NO: 2403 - DNA, 289 bp, Glycine max
  unsure (1)..(289): unsure at all n locations
gtcgcangcacgcgtacgtaagctcggaattcggctcgagcacctctcctcgttcacgctacccctttctgctcttcttctacctttcaagttttaaaagtataaagatggcagagacattcctatttacctcagagtcggtgaacgngngacaccctgacaagctctgcgaccaaatctccgatgctgtcctcgacgcttgcctcgagcaggacccagacagnaaagntnccngcgaaacanntcaccaaaaccaacntngnnanngncatnggagaaancacgacca

SEQ ID NO: 2404 - DNA, 316 bp, Glycine max
  unsure (1)..(316): unsure at all n locations
nnnanaaccttanaagtcgcangcacgcgtacgtaagctcggaattcggctcgaggctgcgagaagacgacagaagggggcagcgcttgatttgaggccgggcaagccccactcaaccaccacacctctcctcgttcacgctacccctttctgctcttcttctacctttcaagttttaaaagtataaagatggcagagacattcctatttacctcagagtcggtgaacgagggnnaccctgacaagctctgcgaccaaatctccgatgctgtcctcgacgcttgcctcgagcaggacccagacagcaaagttgcct

SEQ ID NO: 2405 - DNA, 264 bp, Glycine max
  unsure (1)..(264): unsure at all n locations
cgtcgcatgcacgcgtacgtaagctcggaattcggctcgagntttggagtttggagcgactgaactaatcattaatttgcactcgctgtttcagcttcatgcacccttcttttgcatcatttatatctcttgagaaatggcacaagncacctttctattcacatctgantctgtaaacgagggtcaccccgacatgctgtncgaccagatctctgatgcagtacttgatgcgtgccttgaacaggaccctgacagcaaggttgn

SEQ ID NO: 2406 - DNA, 308 bp, Glycine max
  unsure (1)..(308): unsure at all n locations
nctagcacncgtacgtaagctcgggaattcanctcganngcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctgccgatgctgtcctgcgacgcttgcctcgagcaggacccagacagcaaagttgcctggcgaaacatgtaccaaaaccaacttggtcatggtnttcggagaaatcacga

SEQ ID NO: 2407 - DNA, 331 bp, Glycine max
  unsure (1)..(331): unsure at all n locations
tgcttgcacgcgtacgtaagctcggaattcggctcgaggttgagaccaagacacactcgttcatatatctctnctgctcttctcttcnttctacctctcaagtttttgaagtataaagatggcagagacattcctattcacctcggagtcagtgaacgagggacaccctgataagctctgcgaccaaatctcgatgctgtcctcgacgcttgcctcgaacaggaccagatcagccangttgcctgcgnaaacatgcaccaagaccaattggtcatggtcttcggagagatcaccaccagggccangntgacnncaagatcgtgcgtnacac

SEQ ID NO: 2408 - DNA, 321 bp, Glycine max
  unsure (1)..(321): unsure at all n locations
agtcgcagggacgcgtacgtaagctcggnantcggctcgaggcaagccccactcaaccaccncancgntcctcgttnnacgctacccctttctnggtcttctnctacctttcangttttaaaagtntaaagatggnagagacattcctatttacctcagagtcggtgaacgagggacaccctgagaagctctgcgaccaaatctccgatgtgtcctcgacgcttgcctcgagcaggacccagacagcaaagttgcctgcgaaacatgcaccaaaaccaattggnnaggtcttcggagaatcaggacaaggccaaggtgant

SEQ ID NO: 2409 - DNA, 242 bp, Glycine max
  unsure (1)..(242): unsure at all n locations
ngcacgcgtacgtaagctcggaattcggctcgaggcagacttaacaacagcacaaagcgggntactgtctgttcaagctaccatctctctctctctttcttagtgcctccttgccagaagttaaaatggcccaagaaactttcctattcacatctgaatcagtgaacgaggggcaccctgacaagctctgtgaccagatctccgatgctgtgctcgatncatgcttggagcaaggccctgac

SEQ ID NO: 2410 - DNA, 289 bp, Glycine max
  unsure (1)..(289): unsure at all n locations
catgcacgcgtacgtnagctcggaattcggctcgaggggttactgtctgttcaagctaccatctctctctctctttcttagtgcctccttgccagaagtaaaatggcccaagaaactttcctattcacatctgaatcagtgaacgaggggcaccctgacaagctctgtgaccagatctccgatgctgtgctcgatgcatgcttggagcaggacctgaaagnaaggttcctgtnaanttgcacaancccaatggggggnnttttgggnagnncccacagngggggggggn

SEQ ID NO: 2411 - DNA, 239 bp, Glycine max
  unsure (1)..(239): unsure at all n locations
cagtcgcangcacgcgtacgtaagctcggaattcggctcgagcaacagcacaaagcgggttactgtctgttcaagctaccatctctctctctctttcttagtgcctccttgccagaagttaaaatggcccaaganactttcctattcacatctgaatcagtgaacgaggggcaccctgacaagctctgtgaccagatctccgatgctgtgctcgatgcatgcttggagcaggaccctga

SEQ ID NO: 2412 - DNA, 249 bp, Glycine max
  unsure (1)..(249): unsure at all n locations
catgcacgcgtacgtnanctcggnattcggctcgagcatttgggagttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagctgtgcgaccagatctctgatgcagtgctcgatgcgtgccttgaacaggaccctga

SEQ ID NO: 2413 - DNA, 121 bp, Glycine max
tgtggcaagtggactagccagaaggtgcattgtgcaagtgtcttatgccattggtgtgcccgagcctttgtctgtctttgttgacacctatggcaccgggaagatccatgataaggagatt

SEQ ID NO: 2414 - DNA, 273 bp, Glycine max
  unsure (1)..(273): unsure at all n locations
tctnatgcacgcgtacgtaagctcggaattcggctcgaggccatttgggagttaggttctgcacgctctgcttccagcgagtgttctttcttcgtttcaacaccttaatttgcacacgctgcttcttcagcttgagaaatggcacaagaaacctttctattcacactgaatctgtaaacgagggtcaccccgacaagctgtgcgaccagatctctgatgcagtgctcgatgcgtgccttgaacaggaccctgacagcaaggttgcctgtgaga

SEQ ID NO: 2415 - DNA, 314 bp, Glycine max
  unsure (1)..(314): unsure at all n locations
gcangcacgcgtacgtaagctcggaattcggctcgaggcaaaggagtgatttggagtttggagcgactgaactaatcattaatttgcactcgctgtttcagcttcatcacccttgcttttgcatcatttatatctcttgagaaatggcacaagaaacctttctattcacatctgaatctgtaaacnagggtnaccccgacangcnntncganccagatctctgatgcagtacttgatgcgtgccttgaacaggnccctgacngcaaggttccctgnnagacatgcaccagggccnaacagggtaagggncttgg

SEQ ID NO: 2416 - DNA, 295 bp, Glycine max
  unsure (1)..(295): unsure at all n locations
cgtcgcangcacgcgtacgtnagctcggnnttcggctcganctcgagccgaatcggctcgagtgaggccaggcaagccccactcaancaccacacttctcctcnttcacgctacccctttactnctcttcttctacctttcaagttttaaaagtataaagatggcagagacattcctatttacctcagagtcggtgaacgagggacaccctganaagctctgcgaccanatctccgatgctgtcctcgacgttgcctcgagcaggacccagacagcaaagttgcctgcgaaacat

SEQ ID NO: 2417 - DNA, 250 bp, Glycine max
  unsure (1)..(250): unsure at all n locations
ggccaggcnagccccactcaaccaccacacntctncctcgttcacgctacccctttctgnctcttcttctacctttcatgttttaaaagtataaagatggcagagacattcctatttacctcagagtcggtgaacgagggacancctgacaagctctgcgaccaaatctccgatgctgtcctcgacgcttgcncgagcaggacccagacagcaaagttgcctgngaaacatgcnacaaaaaccaanttgg

SEQ ID NO: 2418 - DNA, 206 bp, Glycine max
  unsure (1)..(206): unsure at all n locations
attaacttggaccttaagaggggtggtcataggttcctcaagacagctgcttanggacactttggaagggatgatgcagacttcacctgggaagttgtgaagccactcaagtcagagaagcctcaagcttaagagtgttgttaagttaatcactcccttcagtggatgtcttgctgggtgtggatgaataatttgcgtgtttcatg

SEQ ID NO: 2419 - DNA, 152 bp, Glycine max
  unsure (1)..(152): unsure at all n locations
nttcgcangcacgcgtacgtaagctcggaattcngctcgaggaaactttcctattcacatctgaatcagtgaacgaggggcaccctgacaagctctgtgaccagatctccgatgctgtgctcgatgcatgcttggannaggaccctgacagt

SEQ ID NO: 2420 - DNA, 319 bp, Glycine max
  unsure (1)..(319): unsure at all n locations
gtctcntgcacgcgtacgtaagctcggaattcggntcgaggtttttgaagtatagagatggcagagncattcctatttacctcagantcngtgaacgaggnacnccctgncangctgctggtgaccaaatctctgatgcngtcctcgacgcttgcctcgaacaggacncanacancanggttgcctggngaancatgcaccaaaaccaacttggtccatggtcttcggagaaatcacgaccaaggccnatgttgactacgagaagatagtgcgtgncacctgcagagcntcggctttgtnctcaaacgatgtgggatgg

SEQ ID NO: 2421 - DNA, 262 bp, Glycine max
  unsure (1)..(262): unsure at all n locations
gcagacttaacaacagcacaaagcnggttagtgtctgttcaagctaccatctctctctctgctttcttagtgcctccttgccagaagttaaaatggcccaagaaactttcctattcacacctgaatcagtgnacgaggggcaccctgacaagctctgtgaccagatctccgatgctgtgctcgatgttgcttggagcaggaccctgacagcaaggttgcnngnaannnctgcaccangacaagnnnggttttgttgncagac

SEQ ID NO: 2422 - DNA, 231 bp, Glycine max
  unsure (1)..(231): unsure at all n locations
gttgcacgcgtacgtaagctcggaattcggctcgaggcagacttaacaacagcacaaagcgggttactgtctgttcaagctaccatctctctctctctttcttagtgcctccttgccagaagttaaaatggcncaagaaactttcctattcacatctgaatcagtgaacgaggggcaccctgacaagctctgtgaccagatctccgatgctgtgctcgatgcatgcttgga

SEQ ID NO: 2423 - DNA, 248 bp, Glycine max
  unsure (1)..(248): unsure at all n locations
ctaatgcacgcgtacgtnagctcggaattcggctcgaggtgatttggagtttggagcgactgaactaatcattaatttgcactcgctgtttcagcttcatcacccttcttttgcatcatttatatctcttgagaaatggcacaagaaacctttctattcacatctgaatctgtaaacgagggtcaccccgacangctgtncnaccagatctctgatgcagtacttgatgcgtgccttgancaggaccc

SEQ ID NO: 2424 - DNA, 322 bp, Glycine max
  unsure (1)..(322): unsure at all n locations
tcgcaggcacgcgtacgtaagctcggaattcggctcgagncagacttaacaacagcacaaagcgggttactgtctgttcaagctaccatctctctctctcctttcttagtgcctccttgccagaagttaaaatggcccaagaaactttccnattcacatctgaatcagtgaacgaggggcaccctgaacaagctctgtgaccagatnctccgatggctgtgctcgatgncatgcttggagcaggaccctgacagcaaggttgcctgtgaaacctgcaccaggaccaacatggtgatggttttcgagagatcacaaccaaggc

SEQ ID NO: 2425 - DNA, 317 bp, Glycine max
  unsure (1)..(317): unsure at all n locations
tcgcangcacncgtacgtnagctcggaattcggctcgagnngccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagaacagcaaagttgcctgcgaaactggcaccaacaccaattggtcatggtcntcggagaaatcncgaccagg

SEQ ID NO: 2426 - DNA, 287 bp, Glycine max
  unsure (1)..(287): unsure at all n locations
angcacgcgtacgtaagctcggaattcggctcgagcggctgcgagaagacgacagaagggggcagcgcttgatttgaggccaggcaagccccacttcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagaca

SEQ ID NO: 2427 - DNA, 347 bp, Glycine max
  unsure (1)..(347): unsure at all n locations
cncccnnangtcgcatgcacgcgtacgtaagctcggaattcggctcgagacggctgcnnagaagacgacagaagggggcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacagcaaattgcctgcgaaacatgcaacaaaaacaanttgtcanggnc

SEQ ID NO: 2428 - DNA, 288 bp, Glycine max
  unsure (1)..(288): unsure at all n locations
gntcangcacgcgtacgtaagctcggaattcngctcgagcannagcataaagcgggttactgtctgttcaagctacncatctctctctctcttncttagtgcctccttnccagaagttannatggcccaagaaactttcctattcacatctgaatcagtgaancgaggggcaccctgacaagctctgtgaccagatctccgatgctgtgctcgatgcatgcttggagcaggangngacagcanggttgcctgtgaaacctgcaccaagancaacatggtgatgntttt

SEQ ID NO: 2429 - DNA, 226 bp, Glycine max
  unsure (1)..(226): unsure at all n locations
ctgcacncgtacgtnagctcggcacncggctccactnaaccaccacacctcnccctcgttcacgctacccctttctgctcttncttctacctttccaagttttaaaagtntaaagatggcagagacattcctatttacctcagagtcggtgaacgagggacaccctgacaagctctgcgaccaaatctccgatgctgtcctcgacgcttgcctcgagcaggaccca

SEQ ID NO: 2430 - DNA, 287 bp, Glycine max
gcacgcgtacgtaagctcggaattcggctcgagtacggctcgagaagacgacagaagggggcagcgcttgatttgaggccaggcaagccccactcacaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcgagcaggacccagacag

SEQ ID NO: 2431 - DNA, 164 bp, Glycine max
  unsure (1)..(164): unsure at all n locations
gcgtangtaagctcggaattcggctcgaggtcatatgttcggctatgcnactgacgagactcccgagctcatgcccttgagccatgtccttgccacgaagctcggtgcnaagctcancgaggttcggaanaacggganatgcccttggntganncctnntggca

SEQ ID NO: 2432 - DNA, 292 bp, Glycine max
  unsure (1)..(292): unsure at all n locations
gtcgcangcacgcgtacgtaagctcggaattcggctcgagnccatttgggagttaggttctgcacgctctgcttccagcgagtgttctttcttcgtttcaacaccttaatttgcacacgctgcttcttcagcttgagaaatggcacaagaaacctttctattcacatctgaatctgtaaacgagggtcaccccgacaagcnnncgaccagatngcnnangcagtgcgcgangngngncntnnacaggacccngncagcaaggcngnctgnnagacangcancaagaccaaca

SEQ ID NO: 2433 - DNA, 97 bp, Glycine max
  unsure (1)..(97): unsure at all n locations
ccaagaccaacatggtcatggtctctggaganctcacaaccaaggccaccgtagactangagaagattgtccgtgacacatgccgcgaaantggata

SEQ ID NO: 2434 - DNA, 310 bp, Glycine max
  unsure (1)..(310): unsure at all n locations
catgcacgcgtacgtaagctcggaattcggctcgagtacggctgcgagaagacgacagaagggggcaccgcttgagcagacttaacaacagcacaaagcgggttactgtctgttcaagctaccatctctctctctctttcntagtgctccttgccagaagttaaaaatggcccaagaaactttcttattcacatctgaatcagtgaacgaggggcacctgacaagctctgtgaccagatctccgatgctgtgctcgatgcatgcttggagcaggacctgacagcaaggttgctgtgaaacctgcaccaan

SEQ ID NO: 2435 - DNA, 306 bp, Glycine max
  unsure (1)..(306): unsure at all n locations
nagtcgcangcacgcgtacgtaagctcggaattcggctcgagacggctgcnagaagacgacagaagggggcagcgcttgatttgaggccaggcaagccccactcaaccaccacacctctcctcgtncacgctacccctttctgctcttcttctacctttcaagttttaaaagtataaagatggcagagacattcctatttacctcagagtcggtgaacgagggacaccctgacaagctctgcgaccaaatctccgatgctgtcctncgacgcttgcctcgancaggacccagacagcaaagttgcc

SEQ ID NO: 2436 - DNA, 278 bp, Glycine max
  unsure (1)..(278): unsure at all n locations
actncgcatgcacgcgtacgtaagctcggaattcggctcgagttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatctccgatgctgtcctcgacgcttgcctcganggcccagacagcaagnttgcctgcgaaacatncnnc

SEQ ID NO: 2437 - DNA, 315 bp, Glycine max
  unsure (1)..(315): unsure at all n locations
gcacgcgtacgtaagctcggaattcggctcgagatttcttcccatcctttcttccttcaccactttgaacttgaacttagttgggggacttggctgagttagactgtnatgtttaaattgtagtcatggtggtgtttttggctgtgaatttgctcatatgtgctaattatgtgttcttgtttgatgttactctacagaagttaaaatggcccaagaaactttcctattcacatctgaatcagtgaacgaggggcaccctgaacaagctctgtgaccagatctccgatgctgtgctcgatgcatgcttggagcagg

SEQ ID NO: 2438 - DNA, 121 bp, Glycine max
  unsure (1)..(121): unsure at all n locations
attaacttggaccttaagaggggtggtcataggttcctcaagacagctgctnatggacactttggaagggatgatgcagacttcacctgggaagttgtgaagccactcaagtcagagangc

SEQ ID NO: 2439 - DNA, 289 bp, Glycine max
  unsure (1)..(289): unsure at all n locations
gtcgcacgcacgcgtacgtaagctcggaattcggctcgagcaggcaagccccactcaaccaccacacctctcctcgttcacgctacccctttctgctcttcttctacctttcaagttttaaaagtataaagatggcagaganattcctatttacctcagagtcggtgaacgagggacaccctgacaagctctgcganccaaatctccgatgctgtcctcgacgcttgcctcgagcaggncccagacagccaaagttgcctgcgaaacangcagcnaaaccaacttggtc

SEQ ID NO: 2440 - DNA, 310 bp, Glycine max
  unsure (1)..(310): unsure at all n locations
cntcangnacgcgtacgtaagctcggaattcgggctcgagnttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctggggaccaaatctccgatgctgtcctcgacgcttgccntngagcaggacccnganagcaaantngcttgggaaanttgcncaaaaaccatttgggtnngggtntgngnaa

SEQ ID NO: 2441 - DNA, 283 bp, Glycine max
  unsure (1)..(283): unsure at all n locations
angcacgngtacgtnagctcggaattcggctcgagcttaacaacagcacaaagcgggttactgtctgttcaagctaccatatctctctctctnttcttagtgcctnccttgccanaagttaaaatggnccntgaaactttccnattcacatntnnatcagtgaacgaggggcaccccgacaagctctntnatagatcngggtngncagtgctagatgnatgnttggagcangancctnanagcnaggntncctgtgaaaccnggcaccnagaccaacatggtn

SEQ ID NO: 2442 - DNA, 240 bp, Glycine max
  unsure (1)..(240): unsure at all n locations
tgaggccaggcaagccccactcaaccaccacanatnantcctcgttncacgctacccctttctncctcttcttctacctttcangttttaanagtataaagatggcagagacattcctatttacctcagagtcggtgaagagggacaccctgacaagctctgcgaccaaatctccgatgctgtcctcgacgcttgcctcgagcaggacccagacagcaaagttgntggaaacatgcacca

SEQ ID NO: 2443 - DNA, 296 bp, Glycine max
  unsure (1)..(296): unsure at all n locations
tcgcatgcacgcgtacgtaagctcggaattcggctcgagggtttttgaagactgctgcctatggacactttggaagagaagaccctgacttcacatgggaagtggtcaaacccctcaagtgggagaaggcctaagtaantcattccactgctctatgctggaagttttttgagcgttgcccttataatatgtctaatatccataactttccacgtctcttacnctgtgtgtttctctcctcttcctcctattttgttatttgtatgttcttttgtaatttttacgtgatcaactaa

SEQ ID NO: 2444 - DNA, 287 bp, Glycine max
  unsure (1)..(287): unsure at all n locations
gtcgcangcacgcgtacgtaagctcggaattcggctcgagngtggccataggttcctcaagacagctgcttatggacactttggaagggatgaccctgacttcacctgggaagttgtgaagccactcaagtctgagaagcctcaagcttaagattgttgtgaagttaatcactcccttcaatggatgtcttgctaggtgtggatgaataatttgcgtgttccatgactactactacttcattcataggtctaatgtcatctcatcaatacttaaactgttttttttt

SEQ ID NO: 2445 - DNA, 185 bp, Glycine max
  unsure (1)..(185): unsure at all n locations
agcagacttaacaacagcacaaagcgggttactgtctgttcaagctaccannnnnnnnnnnnnnnnntagtgcctccttgccagaagttaaaatggcccaagaaactttcctattcacatctgaatcagtgaacgaggggcaccctgacaagctctgtgaccagatctccgatgctgtgctcgat

SEQ ID NO: 2446 - DNA, 227 bp, Glycine max
  unsure (1)..(227): unsure at all n locations
ngtcnatgcacgcgtacgtaagctcggaattcggctcgaggttnggttctgcacgctctgcttccagcgagtgttctttcttcgtttcaacaccttanatttgcacacgctgcttcttcagcttgagaaatggcacaagaaacctttctattcacatctgaatctgtaaacgagggtcaccccgacaagctgtgcgaccagatctctgatgcagtgctcgatgcgtg

SEQ ID NO: 2447 - DNA, 98 bp, Glycine max
ccttttcagggaaggaccctaccaaggttgacagaagtggtgcctatattgtaaggcaggctgcaaagagtgtcgtggcaaatggccttgctagaagg

SEQ ID NO: 2448 - DNA, 304 bp, Glycine max
  unsure (1)..(304): unsure at all n locations
gtcgcngcacgcgtacgtnagctcggaattnggctcgagctcgagccgcaacagcacaaagcgggttactgtctgttcaagctaccatctctctctcactttcttngtgcctccttgccagangttannatggcccaagaaactttcctattcacatctgaatcagtgaacgaggggcacncnnnacaagctctgtgaccagatctccgatgctgtgctacgatgcatgcttggagcangnaccctgacagcnaagttgcctgtgaaacctggcaccaagancaacatggtgatggttttcgga

SEQ ID NO: 2449 - DNA, 266 bp, Glycine max
  unsure (1)..(266): unsure at all n locations
gtcgcatgcacgcgtacgtaagctcggaattcggctcgaggtgatttggagtttggagcgactgaactaatcnttantttgcactcgctgtttcagcttcatcacccttcttttgcatcatttatatctcttgagaaatggcacaagaaacctttctattcacatctgaatctgtaaacgagggtcaccccgacangctgtgcgaccagatctctgatgcagtacttgnngcgngcctnaaaggnccccancancaaggtcgcctg

SEQ ID NO: 2450 - DNA, 159 bp, Glycine max
tcggaattcggctcgagaacagcacaaagcgggttactgtctgttcaagctaccatctctctctctctttcttagtgcctccttgccagaagttaaaatggcccaagaaactttcctattcacatctgaatcagtgaacgaggggcaccctgacaagct

SEQ ID NO: 2451 - DNA, 289 bp, Glycine max
  unsure (1)..(289): unsure at all n locations
gtcgcangcnngcgtnacgnnnagctcggnattcggctcgagccaagccccactcaaccaccanaccactctctctgctcttcttctacctttccaagtttntaaagtattaagntggcagagacantccnanntanctcagagncngngnangngggncancctgncangcgctncgacnaatctncgatgtgtcctcgacgcttgccttgaacaggacccagacagcaaggttgcctgcgaaacatgcaccaagancaattggtcatggtcttcggagagatcacca

SEQ ID NO: 2452 - DNA, 294 bp, Glycine max
  unsure (1)..(294): unsure at all n locations
gtcgcatgcacgcgtacgtnagctcggaattcggctcgagctcgagccgctccacccaacacgacgagactgtcaccaatgangaaattgntgntgaccttcaaanagcatgtgatcaancctgngatnccngngaantnnctnatnagnagnncantttccnattngaaccnttaaggcggtttggcaatggttggccnnnaggggcnangctgggtctccggggncgaaaaganctttatncggatatttagngngnanggggtgcccatgggggtggtgnttcnccgggan

SEQ ID NO: 2453 - DNA, 181 bp, Glycine max
  unsure (1)..(181): unsure at all n locations
gnngctgcacgcgtacgtnagctcggaattcggctcgagtaacaacagcacaaagcgggttactgtctgttcaagctaccatctctctctctctttcttagtgcctccttgccagaagttaaaatggcccaagaaactttcctattcacatctgaatcagtgaacgaggggcaccctgaca

SEQ ID NO: 2454 - DNA, 268 bp, Glycine max
  unsure (1)..(268): unsure at all n locations
gtcgcatgcacgcgtacgtaagctcggaattcggctcgagtgggagttaggttctgncacgctctgcttccagcgagtgttctttcttcgtttcaacaccttaatttgcacacgctgcttcttcagcttgaggaatggcacaagaaacctttctnttcacatctgantctgtanacganggtcaccccgacaagntgtgcgaaccagatnctctgatggcagtgctcatgcgtgcgctgancaggaccctgacagcaaggttgcctgn

SEQ ID NO: 2455 - DNA, 298 bp, Glycine max
  unsure (1)..(298): unsure at all n locations
cntcgcangcacgcgtacgtgagctcggaattcggctcgagcaggcaaancccacncaaccgncananggaaaaaacgaangcgcnaccccattcngctcntcttcnacctnncangannnaagagnntaaagatggcagagacattcctatttacctcagagtacggtgaacgagggacaccctgacaagctctgcganccaagtctccgatgctgtcctcgncgcttgcctcgagcaggacccagacagcaaagttgcgcagcganacatgcancaagncgnattggnccatggtt

SEQ ID NO: 2456 - DNA, 154 bp, Glycine max
  unsure (1)..(154): unsure at all n locations
caccancagcaaacaannaanaagtcgcatgcacgcgtacgtaagctcggaattcngctcgaggggaagacccaagtgaccgttgagtattacaatgacaatggtgccagggttcctattccgtgtacacaccgtgctaatttccacacaacat

SEQ ID NO: 2457 - DNA, 284 bp, Glycine max
  unsure (1)..(284): unsure at all n locations
cgtcgcangcacgcgtacgtaagctcggnattcggctcgagcacaaagcgggttactgtctgttcaagctaccatctctctctctctttcttagtgcctccttgccagaagttaaaatggcccaagaaactttcctattcacatctgaatcagtgaacgaggggcaccctgacaagctcagagaccagaanancgangcngngcacgacgcaagtccttgagcaggacccagtacagcaaggnnnncagtgnaaccngtaccaagaccaacaggtgatggtcct

SEQ ID NO: 2458 - DNA, 213 bp, Glycine max
  unsure (1)..(213): unsure at all n locations
gtcncangcacacgtacgtaagctcggaattcnnctcgagncaagccccactcaaccaccacacctctcctcgttcacgctacccctttctgctcttcttctanctttcaagttttaaaagtataaagatggcagagacattcctatttacctcagagtcggtgaacgagggacaccctgacaagctctgcgaccaacanctccgatgctgtc

SEQ ID NO: 2459 - DNA, 217 bp, Glycine max
  unsure (1)..(217): unsure at all n locations
gtngcatgcacgcgtacgtnagctcggaattcggctcgagcaacagcacaaagcgggttactgtctgttcaagctaccntctntctctctctttcttagtgcctccttgccagaagttaaaatggnccaagaaactttcctattcacatctgnatcagtgancgangggcaccctgacaagctctgtgaccagatctccgatgctgtgctcgntgca

SEQ ID NO: 2460 - DNA, 233 bp, Glycine max
  unsure (1)..(233): unsure at all n locations
ctangcacgcgtacgtnagctcggaattcggctcgagcagcaaaggagtgatttggagtttggagcgactgaactaatcattaatttgcacttcgctgtttcagcttcatcacccttcttttgcatcatttatatctcttgagaaatggcacaagaaacctttctattcacatctgaatctgtaaacgagggtcaccccgacangctgtgcgaccagatctctgangnagnat

SEQ ID NO: 2461 - DNA, 202 bp, Glycine max
  unsure (1)..(202): unsure at all n locations
gncgcangcacgcgtacgtaagctcggaattcggctcgaggggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgcgaccaaatt

SEQ ID NO: 2462 - DNA, 196 bp, Glycine max
  unsure (1)..(196): unsure at all n locations
nccnnacgtcgcntgcacgcgtacgtaagctcggaattcggctcgaggcagacttaacaacagcacaaagcgggttactgtctgttcaagctaccatnctctctctctctttacttagtgcctccttgccagaagttaaaatggcccaagaaactttcctattcacatctgaatcagtgaacgaggggcaccctga

SEQ ID NO: 2463 - DNA, 323 bp, Glycine max
  unsure (1)..(323): unsure at all n locations
gtcgcangcacgcgtacgtaagctcggaattcggctcgagttaacaacagcacaaagcgggttactgtctgttcaagctaccatctctctctctctttcttagtgcctccttgccaggtgctgccactctctctttctctctcttcatccttctgttgggttggttgtggagtgttgttttctgttgtgcacgtgttgtcattttttaccctcgccacagatctgaagtgttcaagtttggattttgtgcttctggaagttaaaatggcccaagaaactttcctattcacatctgaatcagtgaacgaggggcaccctgacaa

SEQ ID NO: 2464 - DNA, 132 bp, Glycine max
gcatgcacgcgtacgtaagctcggaattcggctcgagcagatggcaagacacaagtaactgttgagtaactacaatgacaatggtgccatggttccagttcgtgtccacactgtcctaatttcccacacaac

SEQ ID NO: 2465 - DNA, 189 bp, Glycine max
  unsure (1)..(189): unsure at all n locations
gggagttaggttctgcacgcnctgngnccagcgagtgtgctntcttcgtgtcaacacctgaatttgcannacgctgcgnctgcagcttgagaaatggcacaagaaaccnngctatncanatctgaatcggtaaacgagggtcacnncgacaagctgtgggaccagatctctgatgcagtgctcgatgcg

SEQ ID NO: 2466 - DNA, 138 bp, Glycine max
  unsure (1)..(138): unsure at all n locations
tngcacgcgtacgtaagctcggnattcggctcgagggagnttggtgntggtgaccaaggtcatatgttcggctatgccnactgacgagnnctcccgagctcatgcccttgagccatgtnccttgccacgaagcttcgg

SEQ ID NO: 2467 - DNA, 341 bp, Glycine max
  unsure (1)..(341): unsure at all n locations
ncctctnancntttacatcganacnacgtacgtnagctcggnattcggctcgagcagacttaacaacagcacaaagcgggttactgtctgttcaagctaccatctctctctctctttcttagtgccctccttgccaggtgctgccactctctctttctctctcttcatccttctgttgggttggttgtggagtgttgttttctgttgtgcacgtgttgtcattttttaccctcgccacagatctgaagtgttcaagtttggattttgtgcttctggaagttaaaatggcccaagaaactttcctattcacatctgaatcagtgaacgaggggcaccctgac

SEQ ID NO: 2468 - DNA, 273 bp, Glycine max
gtcgcatgcacgcgtacgtaagctcggaattcggctcgagaatgacaccacctacccccttctccctataaatggcaactcaatgccccccttagaactcgcagcgcttgatttgaggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgc

SEQ ID NO: 2469 - DNA, 181 bp, Glycine max
  unsure (1)..(181): unsure at all n locations
ggcgcacncagnnttcggctcgagggccaggcaagccccactcaaccaccacacctctcctcgttcacgctacccctttctgctcttcttctacctttcaagttttaaaagtataaagatggcagagacattcctatttacctcagagtcggtgaacgagggacaccctgacaagctctgc

SEQ ID NO: 2470 - DNA, 305 bp, Glycine max
  unsure (1)..(305): unsure at all n locations
gtcgcatgcacgcgtacgtaagctcggaattcggctcgangnagacttaacancagnncaaagcgggttactgtctgntcangctaccatctctcnctctntttcttagtgcctccntgccagnagttnnaatggcccaagnnactttcntantcacatctgantcnntgaacgaggggcacccngataagctctgtgancagatctccgatgctgtgctccgatgnatgcttggagcnggnnnctgncagcnaggntgnctgtgnaacntgcacnangnncancatggtgatggntttcggnga

SEQ ID NO: 2471 - DNA, 199 bp, Glycine max
  unsure (1)..(199): unsure at all n locations
agtcgangcancgtacgtaagctcggaattcggctcgaggcagacttaacaacagcacaaagcgggttactgtctgttcaagctaccatctctctctctctttcttagtgcctccttgccagaagttaaaatggcccaagaaactttcctattcacatctgaatcagtgaacgaggggcaccctgacaagctctgtgat

SEQ ID NO: 2472 - DNA, 327 bp, Glycine max
  unsure (1)..(327): unsure at all n locations
cgcatgcacgcgtacgtaagctcggaattcggctcgagccttgatctcaagaggggtggaaatggcaggttcttgaagactgctgcatatggacactttggcagagatgaccctgacttcacatgggaagtggtgaagccactcaagggggagaaggtacctgcttaactaaaaggggttccaacactcttggcaagggacttttgcactactactggcttcttattatctgattgctaaaattttctctatgtttccttccctcntactcaattctgttttttttttncngtatttttttatgaatttcccccttttttttgtgta

SEQ ID NO: 2473 - DNA, 256 bp, Glycine max
  unsure (1)..(256): unsure at all n locations
ggggtggaaatggcaggttcttgaagactgcngcatatggacactttggcagagatgaccctgacttcacatgggaagtggtgaagccactcaagggggagaaggtacctgcttaactaaaaggggttccaacactcttggcaagggacttttgcactactactggcttcttattatctgattgcnaaaatttnctctatgnntccttccctcttactcaattctgtttttntttttctgtatttttnatgaattc

SEQ ID NO: 2474 - DNA, 214 bp, Glycine max
atggcaggttcttgaagactgctgcatatggacactttggcagagatgaccctgacttcacatgggaagtggtgaagccactcaagggggagaaggtacctgcttaactaaaaggggttccaacactcttggcaagggacttttgcactactactggcttcttattatctgattgctaaaattttctctatgtttccttccctcttactcaatc

SEQ ID NO: 2475 - DNA, 206 bp, Glycine max
atggcaggttcttgaagactgctgcatatggacactttggcagagatgaccctgacttcacatgggaagtggtgaagccactcaagggggagaaggtacctgcttaactaaaaggggttccaacactcttggcaagggacttttgcactactactggcttctattatctgattgctaaaattttctctatgtttccttccctctta

SEQ ID NO: 2476 - DNA, 311 bp, Glycine max
  unsure (1)..(311): unsure at all n locations
cctccncaacagtcgcatgcacgcgtacgtaagtcggaattcngctcgagctgctgcatatggacactttggcagagatgaccctgacttcacatgggaagtggtgaagccacttcaagggggagaaggtacctgcttaactaaaaggggttccaacactcttggcaagggacttttgcactactactggcttcttattatctgattgctaaaattttctctatgtttcctccctcttactcaattctgtttttttttntctgtnttttctnatgaatttcccccttttttttgggnactngnatgtgttc

SEQ ID NO: 2477 - DNA, 300 bp, Glycine max
  unsure (1)..(300): unsure at all n locations
tcgcangcacgcgtacgtaagctcggaattcggctcgaggcatatggacactttggcaganatgaccctgacttcacatgggaagtggtgaagccacttcaagggggagaaggtacctgcttaactaaaaggggttccaacactcttggcaagggacttttgcactactactggcttcttattatctgattgctanaattttctctatgtttccttccctcttactcaattctntttttcnttttctgtatttntttatgaatttccccctttttnttgngnacttgtangngtnctnnc

SEQ ID NO: 2478 - DNA, 291 bp, Glycine max
  unsure (1)..(291): unsure at all n locations
acgtcgcatgcacgcgtacgtaagctcggnattcggctcgagatttcgcatctnctccttctcattccaactccaaaatacacacacacgatggaaaccttcctcttcacctcagaatctncaaacgagggccaccccgacaagatctgtgaccaggtttctgatgccatcctcgatgcttgcttggagcaagacccagagagcaaggttgcctgcgagacctgtacaaaaaccaacatggtcatggtctttggggagatcacaaccaaggccaaggtgaactacgagaat

SEQ ID NO: 2479 - DNA, 308 bp, Glycine max
agtcgcatgcacgcgtacgtaagctcggaattcggctcgagcggctgcgagaagacgacagaaggggttcctcttcaatttcgcatcttctccttctcattccaacttccaaaatacacacacacgatggaaaccttcctcttcacctcagaatctgtaaacgagggccaccccgacaagatctgtgaccaggtttctgatgccatcctcgatgcttgcttggagcaagacccagagagcaaggttgcctgcgagacctgtacaaaaaccaacatggtcatggtctttggggagatcacaaccaaggc

SEQ ID NO: 2480 - DNA, 262 bp, Glycine max
  unsure (1)..(262): unsure at all n locations
cttctgtttctggnttcattngggtgtttggacacaattgctnaattatactttctgttgattgtgttgacgcnggactgaatgaactaatggagtctanaggtgggaaanagaagtcnnnnnnnnnnnnnnnnnaatcattgttctacgaagctcccctcggatacagcatnngaagacgttagaccaaacggtggaatcaagaaattcagatctgctgcttactccaacgtatatnttcttctgatgcagtgattctgta

SEQ ID NO: 2481 - DNA, 420 bp, Glycine max
  unsure (1)..(420): unsure at all n locations
ggnggtnnngaatgatttaggtgncctagccaagacanatgacatcgcgtncacgcntacgtaagntcggaattcggctcgagctcgagccgcaaaaattcgggaagactagtgactgtggttcacctagatcaactctaaagtgctggaatgaggaagatgaggaagagtagtttccttaagtgtctttattattctgtccttgtgaaaataagtctggttttccagatacgttattgtttttctttgttgtcttttttagcttctgttagagaccatttgggcatttagacctttattgtttctattaccatttgaacatcgaatggattaataaatcactttgtttgcgtgcaaaaaaaannacanatctttcnanaaanaaaaaaaannaaaaanaacanaaaaanaaaaaaaaan

SEQ ID NO: 2482 - DNA, 287 bp, Glycine max
  unsure (1)..(287): unsure at all n locations
tcgcatgcacgcgtacgtaagctcggaattcggctcgagcnggaggattaggcctccgagcattgtccaaagaccaattggacgagattcttaaaccagcagagtgcactattgtngcatcactttcaaatgattatgttgactcttatgttctgtcagagtcaagcctgttcgtctatccttataaaattatcatcaaaacttgtgggactaccaaattgcttctgtccatccctgtccattctcaagttgggctgatgctcttgacatagctgtgaaatctgtga

SEQ ID NO: 2483 - DNA, 288 bp, Glycine max
  unsure (1)..(288): unsure at all n locations
acgtcgcangcacgcgtacgtaagctcggaattcggctcgagcgaaaaaagacttgagatatcattttttgaaaatggtgtgtttgctgaccccggaggattaggcctccgagcattgtnccaaagaccaattggacgagattcttaaaccagcagagtgcactattgttgcatcactttcaaatgattatgttgactcttatgttctgtcagagtcaagcctgttcgtctatcctataaaattatcatcaaaacttgtgggactaccaaattgcttctgtccatccc

SEQ ID NO: 2484 - DNA, 306 bp, Glycine max
  unsure (1)..(306): unsure at all n locations
cgctcangcacgcgtacgtaagctcggaattcggctcgagntctgatatatctgantttgantttgacccntgcggatattcaatgaatggnntagaagggagtgctatatccaccatccatgtcactcctgaagatgggttcagttacgcaagttttgaagctgttggttatgactttaatgacatggctctaggtgaanttgtggaaaggantttagcttgcttttgtccagcagagttttctgttgctttgcacattgacatgcatggtgagaaactaanaaatttcccttaganatcaaagg

SEQ ID NO: 2485 - DNA, 314 bp, Glycine max
  unsure (1)..(314): unsure at all n locations
gtctatgcacgcgtacgtaagcnncggaatncggctcgaggtctgatatatctgattttgaatttgacccttgcggatattcaatgaatggaatagaagggagtgctatatccaccatccatgtcactcctgaagatggtttcagttacgcaagttttgaagctgttggttatgactttaatgacatggctctaggtgaacttgtggaaaggattttagctgcttttgtccagcagagttttctgttgcttgcacatgacatgcagnctgagaaantaataaattccctagacatcaaaggatactactgtggt

SEQ ID NO: 2486 - DNA, 476 bp, Glycine max
  unsure (1)..(476): unsure at all n locations
aactccnctccgntcgnncgtgnnntngtacagaagtcccggctcgacccacacgtcagctccttcaaactccatctttccaaatcctctctttgcgattgtgttttgatctgcttcctactgcgatagtttctctactgttacatggccatggcggtttccgcaattggttttgaaggtttcgagaaaaggttggaaatatcctttttccagccgggactttttgctgaccctgaaggaaggggtctaagggctcttacaaaatcccagttgggtgagattctaacaccagctgcttgcaccattgtttcttcgctcaaaaacgataatgtcgactcctatgttctatctgagtccagcctctttgtttatgcctacaagatcatcatcaaaacctgtggtactactaagctattgcttgcaatcccacccatattgaagttcgctgaaatgctttcccntaatgttaagtcngt

SEQ ID NO: 2487 - DNA, 510 bp, Glycine max
  unsure (1)..(510): unsure at all n locations
gnngnaaggttgntnagnaacgggggtanatngaannnnnnnnnnnnnnnnnnnnnnnnnnnnnnnnnnnnnnnnnnnnnnnnnnnnnnnnnnnnnnnnnnnnnnnnngtgcatgactggcctggatagagagaaagcacaggttttctacaaagaacaatctgcttcagctgccatgatgactgttaattccggcattagaaaaattcttccagattccgagatttgtgactttgactttgaaccatgtggttattcaatgaactctgttgaaggcgctgctgtttctacgattcatgttaccccagaagatggtttcagttatgcaagcttcgaaactgttggttatgacttcaaagcggtgaatctgaacgaaatgggttcaaganggtattggcatgtttcctnccaactgagtttctgttgcagtcaatgtggatggtgcaagcaagtcgtttgaccanacctgcttctggatgttaagggatactgnctgaaaagaggaacccc

SEQ ID NO: 2488 - DNA, 560 bp, Glycine max
  unsure (1)..(560): unsure at all n locations
gnnnngnnnnnnntnnnaagtaagtnaaanctctntggaaagcncctaccggtncggaattcccggcccgacccacgcgtccggcttcagctgccattatgactgttaattctggcattagaaaaattcttccagantctgagatttgtgactttgactttgagccatgtggttattcaatgaactctgttgaaggtgctgctgtttctaccattcatgttaccccagaagatggttncagttatgcaagctttgagactgttgggnatgacttcaaagtggtgaatctgaacgaaatggttaagaggggattggcatgttttctcccaactgagttctctgttgcagttcatgtggatggtgcaagcaagttgtttgatcagacgtgtnttctggatgttaagggatactgtcgcgaagagaggagcccacgaaagggnttgggaatgggtggnnntcttggctaccaaaaaaantgccaaagacttgggaactgggggtcaactaganccaactctgaaangntggaaaagaaggaagatgaagaaagagtagttttt

SEQ ID NO: 2489 - DNA, 485 bp, Glycine max
  unsure (1)..(485): unsure at all n locations
gngnnnnngnnnnnnnnnnntnnntttnngtggcntanagcccnnnataacancatcacgtcgcangcatgannncgnaantcggctccganggttattcaatgaactctgttgaaggtgctgctgtttctaccattcatgttaccccagaagatggtttcagttatgcaagctttgagactgttgggtatgacttcaaagtggtgaatctgaacgaaatggttaagagggtattggcatgttttctcccaactgagttctctgttgcagttcatgtggatggtgcaagcaagttgtttgatcagacgtgttttctgggatgttaagggatactgtcgcgaagagaggagccacgaagggcttggaatgggtggttctcttgtctaccaaaaatttgccaagacttgtgactgtggttcanctanattaactcctgaaatgctgggaaagaaggaanattaaanaanaataattttccttaagtg

SEQ ID NO: 2490 - DNA, 339 bp, Glycine max
gcatgactggcctggatagagagaaagcacaggttttctacaaagaacaatctgcttcagctgccatgatgactgttaattccggcattagaaaaattcttccagattccgagatttgtgactttgactttgaaccatgtggttattcaatgaactctgttgaaggcgctgctgtttctacgattcatgttaccccagaagatggtttcagttatgcaagcttcgaaactgttggttatgacttcaaagcggtgaatctgaacgaaatggttcagagggtattggcatgtttcctcccaactgagttttctgttgcagttcatgtggatggtgcaagca

SEQ ID NO: 2491 - DNA, 412 bp, Glycine max
  unsure (1)..(412): unsure at all n locations
gtttcagttatgcaagctttgagactgttgggtatgacttcaaagtggtgaatctgaacgaaatggttaagagggtattggcatgttttctcccaactgagttctctgttgcagttcatgtggatggtgcaagcaagttgtttgatcagacgtgttttctggatgttaagggatactgtcgcgaagagaggagccacgaagggcttggaatgggtggttctcttgtctaccaaaaatttgccaagacttgtgactgtggttcacctagatcaactctgaagtgctggaaagaggaagatgaagaagagtagttttcttaagtgtctttattatgtccttgcgaaaataagtccggttttccagacagtgattgtttntctttggtgntttttnccttntatgttagaccatg

SEQ ID NO: 2492 - DNA, 504 bp, Glycine max
  unsure (1)..(504): unsure at all n locations
agtgtntntgnnaggggggannatggtaacactctcgaagactatgacgtcgcatgcacgcgtacgtaagctcggaattcggctcgagtgcatgcaaccatagttttattaggattttttcttctttgttttcaattaggtttttttgttgctctccttcaaactccatctttccaaatcctctctttgcgattgtgttttgatctgcttcctactgcgatagtttctctactgttacatggccatggcggtttccgcaattggttttgaaggtttcgagaaaaggttggaaatatcctttttccagccgggactttttgctgaccctgaaggaaggggtctaagggctcttacaaaatcccagttgggtgagattctaacaccagctgcttgcaccattgtttcttcgctcaaaaacgataatgtcgactcctatgttctatctgagtccagcctctttggttatgcctacaagatcatcatcaaaacctgngggactactaa

SEQ ID NO: 2493 - DNA, 347 bp, Glycine max
  unsure (1)..(347): unsure at all n locations
tgcaattggttttgaaggtttcgagaagangctggaaatatcctttttccagcngggactttttgctgaccctgagggaatgggtttaagagctcttgcanagtcccagttggatgagatacttacaccggctgcttgcaccattgtttcatctctcagaaatgatcatgtcgactcctatgttctgtctgagtccagtctctttgtttatgcctacaagatcatcatcaaaacctgtggtactacaaagctactgcttgcaatcccacccatattgaaatttgctgaaatgctttcctcaatgtagatctgtgnaatacaccagggaagttcanctttnccggtgt

SEQ ID NO: 2494 - DNA, 314 bp, Glycine max
  unsure (1)..(314): unsure at all n locations
gtcgcatgcacgcgtacgtaagctcggaattcggctcgaggccatggcggtttctgcaattggttttgaaggtttcgagaagangctggaaatatcctttttccagccgggactttttgctgaccctgagggaatgggtttaagagctcttgcaaagtcccagttggatgagatacttacaccggctgcttgcaccattgtttcatctcncagaaatgatcatgtcgactcctatgttctgtctgagtccagtctctttgtttatgcctacaagatcatcatcaaaacctgtggtactacaaagctactgcttg

SEQ ID NO: 2495 - DNA, 314 bp, Glycine max
  unsure (1)..(314): unsure at all n locations
aangcacgcgtacgtaagctcggaattcggctcgagaaacaatctgcttcagctgccattatgactgttaattctggcattagaaaaattcttccagattctgagatttgtgactttgactttgagccatgtggttattcaatgaactctgttgaaggtgctgctgtttctaccattcatgttaccccagaagatggtttcagttatgcaagctttgagactgttgggtatgacttcaaagtggtgaatctgaacgaaatggttaagagggtattggcatgttttctcccaactgagttctctgttgcagttca

SEQ ID NO: 2496 - DNA, 320 bp, Glycine max
  unsure (1)..(320): unsure at all n locations
gtacgtanagctcggaattcggctcgagtggcattagaaaaattcttccagattctgagatttgtgactttgactttgagccatgtggttattccaatgaactctgttgaaggtgctgctgtttctaccattcatgttaccccagaagatggtttcagttatgcaagctttgagactgttgggtatgactcaaagtggtgaatctgaacgaaatggttaagagggtattggcatgttttctcccaactgagttctctgttgcagttcatgtggatggtgcaagcaagttgtttgatcagacgtgttttctggatgttaag

SEQ ID NO: 2497 - DNA, 293 bp, Glycine max
  unsure (1)..(293): unsure at all n locations
gtngcangcacgcgtacgtaagctcggaattcggctcgaggccatggcggtttccgcaattggttttgaaggtttcgagaaaaggttggaaatatcctttttccagccgggactttttgctgaccctgaaggaaggggtctaagggctcttacaaaatcccagttgggtgagattctaacaccagctgcttgcaccattgtttcttcgctcaaaaacgataatgtcgactcctatgttctatctgagtccagcctctttgtttatgcctacaagatcatcatcaaaacctgtg

SEQ ID NO: 2498 - DNA, 327 bp, Glycine max
  unsure (1)..(327): unsure at all n locations
nnntaanangtcgnangcacgcgtacgtaagctcngaattcggctcgagcttcaaagtggtgaatctgaacgaaatggttaagagggtattnncctgttttctcccaactgagttctctgttgccgttcatgtgnatggtgcaagcaagttgtttgatcagacgtgttttctggatgttaagggatactgtcgcgaagagaggagccacgaagggcttggaatgggtggttctcttgtctaccaaaaatttgccaagacttgtgactgtggttcacctagatcaactctgaagtgctggaaagaggaagatgaagaagagtagtttt

SEQ ID NO: 2499 - DNA, 284 bp, Glycine max
tgtctgagtccagtctctttgtttatgcctacaagatcatcatcaaaacctgtggtactacaaagctactgcttgcaatcccacccatattgaaatttgctgaaatgctttccctcaatgttagatctgtgaattacaccaggggaagtttcatctttcccggtgctcagccctatccccatcgcaacttttctgaggaagttgctattcttgatggctactttggcaagcttagtgcaggaagcaatgcttatattttgggtggccaagacaaatcacagaac

SEQ ID NO: 2500 - DNA, 299 bp, Glycine max
  unsure (1)..(299): unsure at all n locations
gtcgcangcacgcgtacgtaagctcggaattcggctcgagntttccgcaattggttttgaaggtttcgagaaaaggttggaaatatcctttttccagccgggactttttgctgaccctgaaggaaggggtctaagggctcttacaaaatcccagttgggtgagattctaacaccagctgcttgcaccattgtntcttcgctcaaaaacgataatgtcgactcctatgttctatctgagtccagcctctttgtttatgcctacaagatcatcatcaaaacctgtggtactactaagctat

SEQ ID NO: 2501 - DNA, 256 bp, Glycine max
aattggttttgaaggtttcgagaaaaggttggaaatatcctttttccagccgggactttttgctgaccctgaaggaaggggtctaagggctcttacaaaatcccagttgggtgagattctaacaccagctgcttgcaccattgtttcttcgctcaaaaacgataatgtcgactcctatgttctatctgagtccagcctctttgtttatgcctacaagatcatcatcaaaacctgtggtactactaagctattgctt

SEQ ID NO: 2502 - DNA, 315 bp, Glycine max
  unsure (1)..(315): unsure at all n locations
ntcgcatgcacgcntacgtaagctcggaattcggctcgagtngcggtttccgcaattggttttgaaggtttcgagaaaaggttggaaatatcctttttccagccgggactttttgctgaccctgaaggaaggggtctaagggctcttacaaaatcccagttgggtgagattctaacaccagctgcttgcaccattgtttcttcgctcaaaaacgataatgtcgactcctatgttctatctgagtccagcctctttgtttatgcctacaagatcatcatcaaaacctgtggtaactactaagctattgcttgcaat

SEQ ID NO: 2503 - DNA, 312 bp, Glycine max
  unsure (1)..(312): unsure at all n locations
cangcacgcgtacgtaagctcggaattcggctcgaggttaattctggcattagaaaaattcttccagattctgagatttgtgactttgactttgagccatgtggttattcaatgaactctgttgaaggtgctgctgtttctaccattcatgttaccccagaagatggtttcagttatgaagctttgagactgttgggtatgacttcaaagtggtgaatctgaacgaaatggttaagagggtattggcatgttttctcccaactgagttctctgttgcagttcatgtggatggtgcaagcaagtngtttgatc

SEQ ID NO: 2504 - DNA, 440 bp, Glycine max
  unsure (1)..(440): unsure at all n locations
ccacgcgtccgccagattgatagttcattgcatgcaaccatagttttattaggttttttcttctttgntttcaattaggtttttgctgctctccttcaaactccgtctttccgaatcctctctttgtgattgtgttctgttctgcttcctaccgcgatagtttctcttctgaagcatggccatggcggtttctgcaattggttttgaaggtttcgagaagaggctggaaatatcctttttccagccgggactttttgctgaccctgagggaatgggtttaagagctcttgcaaagtcccagttggatgagatacttacaccggctgcttgcaccattggttcatctctcagaaatgatcatgtcgactcctatggtctggctgaagtccagtctctttggttatgcctacaagatcattatcaaaacctggggtactaca

SEQ ID NO: 2505 - DNA, 287 bp, Glycine max
gtcgcatgcacgcgtacgtaagctcggaattcggctcgagggcggtttccgcaattggttttgaaggtttcgagaaaaggttggaaatatcctttttccagccgggactttttgctgaccctgaaggaaggggtctaagggctcttacaaaatcccagttgggtgagattctaacaccagctgcttgcaccattgtttcttcgctcaaaaacgataatgtcgactcctatgttctatctgagtccagcctctttgtttatgcctacaagatcatcatcaaaacctgt

SEQ ID NO: 2506 - DNA, 298 bp, Glycine max
  unsure (1)..(298): unsure at all n locations
nngcatgcacncgtacgtaagctcggaattcggctcgaggctgtttctacgnttcatgttaccccagaagatggtttcagttatgcaagcttcgaaactgttggttatgacttcaaagcggtgaatctgaacgaaatngttcagagggtattggcatgtttcctcccaactgagttttctgttgcagttcatgtggatggtgcaagcaagtcgtttgagcagacctgctttctggatgttaagggatactgtcgtgaagagaggagccacgaagggcttggaatgggtggttctgttg

SEQ ID NO: 2507 - DNA, 505 bp, Glycine max
  unsure (1)..(505): unsure at all n locations
ccacgcgtccgcttgatggctactttggcaaacttggtgcaggaagcaatgcttatattttgggtggccaanacnaagcacagaactggcatgtctactctgcttctgcagattctgtaactcaatgtgacaatgtttacactcttgagatgtgcatgactggcctggatagagagaaagcacaggttttctacaaagaacaatctgcttcagctgccatgatgactgntaattccggcattagaaaaattcttccaaattcccagaattgngactttgnntttgaaccatgtggntattcaatgaactntgnttgaaaggcncttgtggttctacgattcatggtanccccagaagatgggtcanntattgcaagctttgnaaactnttgggtatgactttaaagccggngaatntgaacccaaaaggnttaaanggatttggcatggttcctccaacttaantttctgtncaantcattggggaangtgcaagcaagnntttt

SEQ ID NO: 2508 - DNA, 294 bp, Glycine max
  unsure (1)..(294): unsure at all n locations
gtcgcatgcacgcgtacgtaagctcggaattcggctcgagctttgaaccatgtggttattcaatgaactctgttgaaggcgctgntgtttctacgattcatgttaccccagaagatggtttcagttatgcaagcttcgaaactgttggttatgacttcaaagcggtgaatctgaacgaaatggttcagagggtattggcatgtttcctcccaactgagttttctgttgcagttcatgtggatggtgcaagcaagtcgtttgagcagacctgctttctggatgttaagggatact

SEQ ID NO: 2509 - DNA, 296 bp, Glycine max
  unsure (1)..(296): unsure at all n locations
agtcgcnngcacgcgtacgtaagctcggaattcggctcgaggttttctacaaagaacaatctgcttcagctgccattatgactgttaattctggcattagaaaaattcttccagattctgagatttgtgactttgactttgagccatgtggttattcaatgaactctgttgaaggtgctgctgtttctaccattcatgttaccccagaagatggtttcagttatgcaagctttgagactgttgggtatgacttcaaagtggtgaatctgaacgaaatggttaagagggtattggca

SEQ ID NO: 2510 - DNA, 254 bp, Glycine max
ggactttttgctgaccctgaaggaaggggtctaagggctcttacaaaatcccagttgggtgagattctaacaccagctgcttgcaccattgtttcttcgctcaaaaacgataatgtcgactcctatgttctatctgagtccagcctctttgtttatgcctacaagatcatcatcaaaacctgtggtactactaagctattgcttgcaatcccacccatattgaagttcgctgaaatgctttcccttaatgttaa

SEQ ID NO: 2511 - DNA, 299 bp, Glycine max
tcgcatgcacgcgtacgtaagctcggaattcggctcgagaggcgctgctgtttctacgattcatgttaccccagaagatggtttcagttatgcaagcttcgaaactgttggttatgacttcaaagcggtgaatctgaacgaaatggttcagagggtattggcatgtttcctcccaactgagttttctgttgcagttcatgtggatggtgcaagcaagtcgtttgagcagacctgctttctggatgttaagggatactgtcgtgaagagaggagccacgaagggcttggaatgggtggtt

SEQ ID NO: 2512 - DNA, 257 bp, Glycine max
gtcgactcctatgttctatctgagtccagcctctttgtttatgcctacaagatcatcatcaaaacctgtggtactactaagctattgcttgcaatccacccatattgaagttcgctgaaatgctttcccttaatgttaagtctgtgaattacaccaggggaagtttcattttccccagtgctcagccatatccccatcgcaacttttctgaggaagttgctattcttgatggctactttggcaaacttggtgcagga

SEQ ID NO: 2513 - DNA, 310 bp, Glycine max
  unsure (1)..(310): unsure at all n locations
gtcgcngcacgcgtacgtaagctcggaattcggctcgagctcgagccgctcctatgttctatctgagtccagcctctttgtttatncctacaagatcatcanccaaaacctgtggtactactaagctattgcttgcaatcccacccatattgaagttcgctgaaatgctttcccttaatgttaagtctgtgaattacaccaggggaagtttcattttccccagtgctcagccatatccccatcgcaacttttctgaggaagttgctattcttgatggctactttggcaaacttggtgcaggaagcaatgc

SEQ ID NO: 2514 - DNA, 322 bp, Glycine max
  unsure (1)..(322): unsure at all n locations
tcgcangcacgcgtacgtaagctcggaattcggctcgagcagagggtattggcatgtttcctcccaactgagttttctgttgcagttcatgtggatggtgcaagcaagtcgtttgagcagacctgctttctggatgttaagggatactgtcgtgaagagaggagccacgaagggcttggaatgggtggttctgttgtctaccaaaaattcgggaagactagtgactgtggttcacctagatcaactctaaagtgctggaatgaggaagatgaggaagagtagtttccttaagtgtctttattattctgtccttgtgaaaata

SEQ ID NO: 2515 - DNA, 314 bp, Glycine max
  unsure (1)..(314): unsure at all n locations
aannnngaancgcangcncgcgnacgtnanctcggaattnngctcnaggtctaaggnctcttacaaaatcccagttgggtgagattctnacaccagctgcttgcaccattgtttcttcgctcaaaaacgataatgtcgactcctntgttctatctgantccagcctctttgtntatgcctacnagatcatcatcaaaacctgtggtactactaagctattgcttgcnatcccacccatattgaagttngctganatgctttcccttaatgttaagtctgtgaattacaccaggggaagtttcattttccccagt

SEQ ID NO: 2516 - DNA, 283 bp, Glycine max
gatgcacgcgtacgtaagctcggaattcggctcgaggtgactttgactttgagccatgtggttattcaatgaactctgttgaaggtgctgctgtttctaccattcatgttaccccagaagatggtttcagttatgcaagctttgagactgttgggtatgacttcaaagtggtgaatctgaacgaaatggttaagagggtattggcatgttttctcccaactgagttctctgttgcagttcatgtggatggtgcaagcaagttgtttgatcagacgtgttttct

SEQ ID NO: 2517 - DNA, 247 bp, Glycine max
gtccagcctctttgtttatgcctacaagatcatcatcaaaacctgtggtactactaagctattgcttgcaatcccacccatattgaagttcgctgaaatgctttcccttaatgttaagtctgtgaattacaccaggggaagtttcattttccccagtgctcagccatatccccatcgcaacttttctgaggaagttgctattcttgatggctactttggcaaacttggtgcaggaagcaatgcttat

SEQ ID NO: 2518 - DNA, 336 bp, Glycine max
  unsure (1)..(336): unsure at all n locations
gtcgcangcacgcgtacgtaagctcggaattcggctcgaggccatatccccatcgcaacttttctgaggaagttgctattcttgatggctactttggcaaacttggtgcaggaagcaatgcttatattttgggtggccaagacaaagcacagaactggcatgtctactctgcttctgcagattctgtaactcaatgtgacaatgtttacactcttgagatgtgcatgactggcctggatagagagaaagcacaggttttctacaaagaacaatctgcttcagctgccatgatgactgttaattccggcattagaaaaattcttccagattccgaga

SEQ ID NO: 2519 - DNA, 306 bp, Glycine max
agtcctatgcacgcgtacgtaagctcggaattcggctcgagatcaaaacctgtggtactactaagctattgcttgcaatcccacccatattgaagttcgctgaaatgctttcccttaatgttaagtctgtgaattacaccaggggaagtttcattttccccagtgctcagccatatccccatcgcaacttttctgaggaagttgctattcttgatggctactttggcaaacttggtgcaggaagcaatgcttatattttgggtggccaagacaaagcacagaactggcatgtctactctgcttctg

SEQ ID NO: 2520 - DNA, 247 bp, Glycine max
catgtcgactcctatgttctgtctgagtccagtctctttgtttatgcctacaagatcatcatcaaaacctgtggtactacaaagctactgcttgcaatcccacccatattgaaatttgctgaaatgtttccctcaatgttagatctgtgaattacaccaggggaagtttcatctttcccggtgctcagccctatccccatcgcaacttttctgaggaagttgctattcttgatggctactttggcaa

SEQ ID NO: 2521 - DNA, 282 bp, Glycine max
  unsure (1)..(282): unsure at all n locations
gtcncatgcacgcccaacgtaagctcggaattcggctcgaggtttacactcttgagatgtgcatgactggcctggatagagagaaagcacaggttttctacaaagaacaatctgcttcagctgccatgatgactgttaattccggcattagaaaaattcttccagattccgagatttgtgactttgactttgnaccatgtggttattcaatgaactctgttgaaggcgctgctgtttctacgattcatgttaccccagaagatggtttcagttatgcaagct

SEQ ID NO: 2522 - DNA, 305 bp, Glycine max
  unsure (1)..(305): unsure at all n locations
gcatgcacgcgtacgtaagctcggaattcggctcgagnaaaacctgtggtactactaagctattgcttgcaatcccacccatattgaagttcgctgaaatgctttcccttaatgttaagtctgtgaattacaccaggggaagtttcattttccccagtgctcagccatatccccatcgcaacttttntgaggaagttgctattcttgatggctactttggcaaacttggtgcaggaagcaatgcttatattttgggtggccaagacaaagcacagaactggcatgtctactctgcttctgcagat

SEQ ID NO: 2523 - DNA, 287 bp, Glycine max
cgtatgcacgcgtacgtaagctcggaattcggctcgagctcttctgaagcatggccatggcggtttctgcaattggttttgaaggtttcgagaagaggctggaaatatcctttttccagccgggactttttgctgaccctgagggaatgggtttaagagctcttgcaaagtcccagttggatgagatacttacaccggctgcttgcaccattgtttcatctctcagaaatgatcatgtcgactcctatgttctgtctgagtccagtctcttgtttatgcctacaaga

SEQ ID NO: 2524 - DNA, 276 bp, Glycine max
  unsure (1)..(276): unsure at all n locations
tcgcangcacgcgtacgtnagctcggaattcggctcgagggcattagaaaaattcttccagattctgagatttgtgactttgactttgagccatgtggttattcaatgaactctgttgaaggtgctgctgtttctaccattcatgttaccccagaagatggtttcagttatgcaagctttgagactgttggncatgacttcaaagtggtgaatctgaacgaaatggttaagagggtattggcatgttttctcccaactgagttcgtgttgcagttc

SEQ ID NO: 2525 - DNA, 302 bp, Glycine max
  unsure (1)..(302): unsure at all n locations
gtcgcatgcacgcgtacgtaagctcggaattcggctcgagcccaactgagttctctgttgcagttcatgtggatggtgcaagcnagttgtttgatcagacgtgttttctggatgttaagggatactgtcgcgaagagaggagccacgaagggcttggaatgggtggttctcttgtctaccaaaaatttgccaagacttgtgactgtggttcacctagatcaactctgaagtgntggaaagaggaagatgaagaagagtagttttcttaagtgtctttattatgtccttgcgaaaataagtcc

SEQ ID NO: 2526 - DNA, 274 bp, Glycine max
  unsure (1)..(274): unsure at all n locations
cangcacgcgtacgtaagctcggaattcggctcgagaaaacgataatgtcgactcctatgttctatctgagtccagcctctttgtttatgcctacaagatcatcatcaaaacctgtggtactactaagctattgcttgcaatcccacccatattgaagttcgctgaaatgctttcccttaatgttaagtctgtgaattacaccaggggaagtttcattttccccagtgctcagccatatccccatcgcaacttttctgaggaagttgctattct

SEQ ID NO: 2527 - DNA, 264 bp, Glycine max
  unsure (1)..(264): unsure at all n locations
ctgcaattggttttgaaggtttcgagaagnngctggaaatatcctttttccagccgggactttttgctgaccctgagggaatgggtttaagagctcttgcaaagtcccagttggatgagatacttacaccggctgcttgcaccatangtttcatctctcagaaatgatcatgtcgactcctatgttctgtctgagtncagtctctttgtttatgcctacaagatcatcatcaaaacctgtggtatacaaagctactgttgcant

SEQ ID NO: 2528 - DNA, 289 bp, Glycine max
  unsure (1)..(289): unsure at all n locations
ntgcacgcgtacgtaagctcggaattcggctcgaggctactgcttgcaatcccacccatattgaaatttgctgaaatgctttccctcaatgttagatctgtgaattacaccaggggaagtttcatctttcccggtgctcagccctatccccatcgcaacttttctgaggaagttgctattcttgatggctactttggcaagcttagtgcaggaagcaatgcttatattttgggtggccaagacaaatcacagaactggcatgtctactctgcttctgcagattctgtaa

SEQ ID NO: 2529 - DNA, 311 bp, Glycine max
  unsure (1)..(311): unsure at all n locations
tcnnangcacgcgtacgtnagctcggaattcggctcgaggcttgcaatcccacccatattgaagttcgctgaaatgctttcccttaatgttaagtctgtgaattacaccaggggaagtttcattttccccagtgctcagccatatccccatcgcaacttttctgaggaagttgctattcttgatggctactttggcaaacttggtgcaggaagcaatgcttatattttgggtggccaagacaaagcacagaactggcatgtctactctgcttctgcagattctgtaactcaatgtgacaatgtttacatct

SEQ ID NO: 2530 - DNA, 308 bp, Glycine max
  unsure (1)..(308): unsure at all n locations
ttntangcacgcgtacgtnagctcggaattcggctcgagcaggaagcaatgcttatatnttgggtggccaagacaaatcacagaactggcatgtctactctgcttctgcagattctgtaactccatgcgacaatgtttacactctagagatgtgcatgactggcctggatagagagaaagcacaggttttctacaaagaacaatctgcttcagctgccattatgactgttaattctggcattagaaaaattcttccagattctgagatttgtgactttgactttgagccatgtggttattcaatgaac

SEQ ID NO: 2531 - DNA, 292 bp, Glycine max
  unsure (1)..(292): unsure at all n locations
tcgcangcacgcgtacgtaagctcggaattcggctcgagcaaagcacagaactggcatgtctactctgcttctgcagattctgtaactcaatgtgacaatgtttacactcttgagatgtgcatgactggcctggatagagagaaagcacaggttttctacaaagaacaatctgcttcagctgccatgatgactgttaattccggcattagaaaaattcttccagattccgagatttgtgactttgactttgaaccatgtggttattcaatgaactctgttgaaggcgctgct

SEQ ID NO: 2532 - DNA, 285 bp, Glycine max
  unsure (1)..(285): unsure at all n locations
cnaangcacgcgtacgtaagctcggaattcggctcgaggcagattctgtaactcaatgtgacaatgtttacactcttgagatgtgcatgactggcctggatagagagaaagcacaggttttctacaaagaacaatctgcttcagctgccatgatgactgttaattccggcattagaaaaattcttccagattccgagatttgtgactttgactttgaaccatgtggttattcaatgaactctgttgaaggcgctgctgtttctacgattcatgttactccagaag

SEQ ID NO: 2533 - DNA, 326 bp, Glycine max
  unsure (1)..(326): unsure at all n locations
gatgcagcgtacgtnagctcggaattcggctcgagaatcctctctttgcgattgtgttttgatctgcttcctactgcgatagtttctctactgttacatggccatggcggtttccgcaattggttttgaaggtttcgagaaaaggttggaaatatcctttttccagccgggactttttgctgaccctgaaggaaggggtctaagggctcttacaaaatcccagttgggtgagatctaacaccagctgcttgcaccattgtttcttcgctcaaaaaacgataatgtcgactcctatgttctatctgagtccagcctctttgtttatg

SEQ ID NO: 2534 - DNA, 502 bp, Glycine max
  unsure (1)..(502): unsure at all n locations
ccacgcgtccggatagttcgttgcatgcaaccatagttttattaggattttttcttctttgntttcaattaggttgttttgntgctctccttcaaactccatctttccaaatcctctctttgcgattgngttttgatctgcttcctactgcgatagnttctctactgntacatggccatggcggtttccgcaattggttttgaaggnttcgagaaaaggntggaaatatcctttttccaaccgggactttttgctgaccctgaaagaaggggtctaaanggctnttacaaaatccaagtgggtgagattctaacaccagctgnttgnaccattggttcttngctnaaaaacgatnatgnccacttctatggtctatctnagttcangctttttgggtatgcctaccaagatcattattnaaaactnngggaccacctaactattggtttnaatcccccntatttgaaattgcttnaanngctttcccttaaggttaaactgg

SEQ ID NO: 2535 - DNA, 291 bp, Glycine max
  unsure (1)..(291): unsure at all n locations
nangtcgcangcacgcgtacgtaagctcggaattcggctcgaggctactgcttgcaatcccacccatattgaaatttgctgaaatgctttccctcaatgttagatctgtgaattacaccaggggaagtttcatctttcccggtgctcagccctatcnccatcgcaacttttctgaggaagttgctattcttgatggctactttggcaagcttagtgcaggaagcaatgcttatattttgggtggccaagacaaatcacagaactggcatgtctactctgcttctgcagatt

SEQ ID NO: 2536 - DNA, 308 bp, Glycine max
  unsure (1)..(308): unsure at all n locations
gcangcacgcgtacgtaagctcgggaattcggctcgagngccaagacaaagcacagaactgggcatgtctactctgcttctgcagattctgtaactcaatgtgacaatgtttacactcttgagatgtgcatgactggcctggatagagagaaagcacaggttttctacaaagaacaatctgcttcagctgccatgatgactgttaattccggcattagaaaaattcttccagattccgagatttgtgactttgactttgaaccatgtggttattcaatgaactctgttgaaggcgctgctgtttctac

SEQ ID NO: 2537 - DNA, 308 bp, Glycine max
  unsure (1)..(308): unsure at all n locations
acgtcgcangcacgcgtacgtaagctcgngaattcggctcgagggcaagcttagtgcaggaagcaatgcttatattttgggtggccaagacaaatcacagaactggcatgtctactctgcttctgcagattctgtaactccatgcgacaatgtttacactctagagatgtgcatgactggcctggatagagagaaagcacaggttttctacaaagaacaatctgcttcagctgccattatgactgttaattctggcattagaaaaattcttccagattctgagatttgtgactttgactttgagccat

SEQ ID NO: 2538 - DNA, 281 bp, Glycine max
gtcgcatgcacgcgtacgtaagctcggaattcggctcgaggtactacaaagctactgcttgcaatcccacccatattgaaatttgctgaaatgctttccctcaatgttagatctgtgaattacaccaggggaagtttcatctttcccggtgctcagccctatccccatcgcaacttttctgaggaagttgctattcttgatggctactttggcaagcttagtgcaggaagcaatgcttatattttgggtggccaagacaaatcacagaactggcatgtcta

SEQ ID NO: 2539 - DNA, 299 bp, Glycine max
  unsure (1)..(299): unsure at all n locations
antcgcatgcacgcgtacgtnagctcggaattcggctcgagattctggcattagaaaaattcttccagattctgagatttgtgactttgactttgagccatgtggttattcaatgaactctgttgaaggtgctgctgtttctaccattcatgttaccccagaagatggtttcagttatgcaagctttgagactgttgggtatgacttcaaagtggtgaatctgaacgaaatggttaagagggtatgggcagttttcttcccaatgagttctctgttgcagttcagtgggaggtgcaaca

SEQ ID NO: 2540 - DNA, 284 bp, Glycine max
  unsure (1)..(284): unsure at all n locations
ntgnncgcgtacgtnagctcggaattnggctcgagctcgagccgttcgagaagaggctggaaatatcctttttccagcnggnactttttgctgaccctgaggncatgggttnangagntcttgcaaagtcccagttggatgagatanttanacncgctgcttgcaccattgtttcatctctcagaaatgatcatgncgantcctatgtnctgtctgagtccagtntcttngtntatgcctacaagatcatcatcaaaacctgnggtactacaaagctactgctt

SEQ ID NO: 2541 - DNA, 297 bp, Glycine max
  unsure (1)..(297): unsure at all n locations
gcgtacgtaagctcggaattcggctcgagnttaggtttttttgttgctctccttcaaactccatctttccaaatcctctctttgcgattgtgttttgatctgcttcctactgcgatagtttctctactgttacatggccatggcggtttccgcaattggttttgaaggtttcgagaaaaggttggaaatatcctttttccagccgggactttttgctgaccctgaaggaaggggtctaagggctcttacaaaatcccagttgggtgagattctaacaccagctgcttgcaccatgtt

SEQ ID NO: 2542 - DNA, 298 bp, Glycine max
  unsure (1)..(298): unsure at all n locations
tcgnngcacgcgtacgtaagctcggaattcggctcgagggccaagacaaatcacagaactggcatgtctactctgcttctgcagattctgtaactccatgcgacaatgtttacactctagagatgtgcatgactggcctggatagagagaaagcacaggttttctacaaagaacaatctgcttcagctgccattatgactgttaattctggcattagaaaaattcttccagattctgagatttgtgactttgacttgagccatgtggttattcaatgaactctgttgaaggtgctgct

SEQ ID NO: 2543 - DNA, 390 bp, Glycine max
  unsure (1)..(390): unsure at all n locations
ttcctgatatccatccagattgatagttcattgcatgcaaccatagttttattaggttttttcttctttgttttcaattaggtttttgctgctctccttcaaactccgtctttccgaatcctctctttgtgattgtgttctgttctgcttcctaccgcgatagtttctcttctgaagcatggccatggcggtttctgcaattggttttgaaggtttcgagaagaggctggaaatatcctttttccagccgggactttttgctgaccctgagggaatgggtttaagagctcttgcaaagtcccagttggatgagatacttacaccggctgcttgcaccattggttcatctctcagaaatgatcatgtcgacttctaaggtctggctgaanc

SEQ ID NO: 2544 - DNA, 284 bp, Glycine max
  unsure (1)..(284): unsure at all n locations
nncngcacgcnnacgtaagctcggaattcggctcgaggggaagtttcattttccccagtgctcagccatatccccatcgcaacttttctgaggaagttgctattcttgatggctactttggcaaacttggtgcaggaagcaatgcttatattttgggtggccaagacaaagcacagaactggcatgtctactctgcttctgcagattctgtaactcaatgtgacaatgtttacactcttgagatgtgcatgactggcctggatagagagaaagcacaggttttc

SEQ ID NO: 2545 - DNA, 295 bp, Glycine max
  unsure (1)..(295): unsure at all n locations
gtcgcnngcacgcgtacgtaagctcggaattcggctcgagctcagccatatccccatcgcaacttttctgaggaagttgctattcttgatggctactttggcaaacttggtgcaggaagcaatgcttatattttgggtggccaagacaaagcacagaactggcatgtntactctgcttctgcagattctgtaactcaatgtgacaatgtttacactcttgagatgtgcatgactggcctggatagagagaaagcacaggttttctacaaagaacaatctgcttcagctgccatga

SEQ ID NO: 2546 - DNA, 310 bp, Glycine max
  unsure (1)..(310): unsure at all n locations
ngtcgcatgcacgcgtacgtaagctcggaattcggctcgagtgctcagccatatccccatcgcaacttttctgaggaagttgctattcttgatggctactttggcaaacttggtgcaggaagcaatgcttatattttgggtggccaagacaaagcacagaactggcatgtctactctgcttctgcagattctgtaactcaatgtgacaatgtttacactcttgagatgtgcatgactggcctggatagagagaaagcacaggttttctacaaagaacaatctgcttcagctggccatgatgactgttaat

SEQ ID NO: 2547 - DNA, 374 bp, Glycine max
  unsure (1)..(374): unsure at all n locations
cacttaaantcgatgcacgcgtacgtaagctcggaattcggctcgagcttgcaccattgtttcatctctcagaaatgatcatgtcgacncctatgttctgtctgagtccagtctctttgtttatggcttacaagatcatcatcaaaacctgtggtactacaaagctactgcttgcaatcccacccatattgaaatttgctgaaatgctttccctcaatgttaatctgtgaattacaccaggggaagtttcatctttcccggtgctcagccctatccccatcgcaacttttctgaggaagttgctattcttgatggctatttggcaagcttagtgcaggaagcaagcttatatttgggtggccagacaaatcaca

SEQ ID NO: 2548 - DNA, 343 bp, Glycine max
  unsure (1)..(343): unsure at all n locations
nnntannccccanacgtcgcangcacgcntacgtnagctcggaattcggctcgagntcttctttgttttcaatnaggtttttttgttgctctccttcaaactccatctttccaaatcctctctttgcgattgtgttttgatctgcttcctactgcgatagtttctctactgttacatggccatggcggtttccgcaattggttttgaaggtttcgagaaaaggttggaaatatcctttttccagccgggactttttgctgaccctgaaggaaggggtctaagggctcttacaaaatcccagttgggtgagattctaacaccagctgcttgcaccattgtttct

SEQ ID NO: 2549 - DNA, 292 bp, Glycine max
  unsure (1)..(292): unsure at all n locations
nnnnnggcngacgtcgcangcacgcgtacgtaagctcggaattcggctcgagcttacaccggctgcttgcaccattgtntcatctctcagaaatgaacatgtcgactcctatgtgctgtctgagtncagtctctntgtttatgcctacaagatcatcatcaaaacctgtggtactanaaagctactgcttgcaatcccanccatattganatntgctgnaatgctttcccncaatgtnagatctgngaattacaccaggggaagtttcntcttncccggtgctcagccctat

SEQ ID NO: 2550 - DNA, 300 bp, Glycine max
  unsure (1)..(300): unsure at all n locations
ngtcgcatgcacgcntacgtaagcncgggaattcggctcgagcaaaatcccagttgggtgagattctaacaccagctgcttgcaccattgtntcttcgctcaaaaacgataatgtcgactcctatgtnctatctgagtccagcctctttgtttatgcctacaagatcatnatcaaaacctgtggtactactaagctattgcttgcaatcccacccatattgaagttcgctgaaatgctttccctaatgttaagtctgtgaattacaccaggggaagtttcatttccccgtgctcagccat

SEQ ID NO: 2551 - DNA, 291 bp, Glycine max
  unsure (1)..(291): unsure at all n locations
nngtcgcatgcacgcgtacgtaagctcggaattcggctcgaggttcatgtggatggtgcaagcaagtcgtttgagcagacctgctttctggatgttaagggatactgtcgtgaagagaggagccacgaagggcttggaatgggtggttctgttgtctaccaaaaattcgggaagactagtgactgtggttcacctagatcaactctaaagtgctggaatgaggaagatgaggaagagtagtttccttaagtgtctttattattctgtcctgtgaaaataagtctggttttc

SEQ ID NO: 2552 - DNA, 294 bp, Glycine max
  unsure (1)..(294): unsure at all n locations
acgtcgcangcacgcgtacgtaagctcggaattcggctcgagtccaaatcctctctttgcgattgtgttttgatctgcttcctactggcgatagtttctctactgttacatggccatggcggtttccgcaattggttttgaaggtttcgagaaaaggttggaaatatcctttttccagccgggactttttgctgaccctgaaggaaggggtctaagggctcttacaaaatcccagttgggtgagattctaacaccagctgcttgcaccattgtttcttcgctcaaaaacgataa

SEQ ID NO: 2553 - DNA, 298 bp, Glycine max
  unsure (1)..(298): unsure at all n locations
nangnacgcgtncgtnacgtcacgtatanctcggcattcggctcgagctttgttttcaattaggtttttttgttgctctccttcaaactccatctttccaaatcctctctttgcgattgtgttttgatctgcttcctactgcgatagtttctctactgttacatggccatggcggtttccgcaattggttttgaaggtttcgagaaaaggttggaaatatcctttttccagccgggactttttgctgaccctgaaggaaggggtctaagggctcttacaaaatcccagttgggtgaga

SEQ ID NO: 2554 - DNA, 274 bp, Glycine max
acgcgtacgtaagctcggaattcggctcgagggtgcaagcaagtcgtttgagcagacctgctttctggatgttaagggatactgtcgtgaagagaggagccacgaagggcttggaatgggtggttctgttgtctaccaaaaattcgggaagactagtgactgtggttcacctagatcaactctaaagtgctggaatgaggaagatgaggaagagtagtttccttaagtgtcttattattctgtccttgtgaaaataagtctggttttccagata

SEQ ID NO: 2555 - DNA, 263 bp, Glycine max
  unsure (1)..(263): unsure at all n locations
ncgtcgcatgcacgcgtacgtaagctcggaattcggctcgagggtgcaagcaagtcgtttgagcagacctgctttctggatgttaagggatactgtcgtgaagagaggagccacgaagggcttggaatgggtggttctgttgtctaccaaaaattcgggaagactagtgactgtggttcacctagatcaactctaaagtgctggaatgaggaagatgaggaagagtagtttccttaagtgtctttattattctgtccttgtga

SEQ ID NO: 2556 - DNA, 275 bp, Glycine max
cacgcgtacgtaagctcggaattcggctcgagggtgcaagcaagtcgtttgagcagacctgctttctggatgttaagggatactgtcgtgaagagaggagccacgaagggcttggaatgggtggttctgttgtctaccaaaaattcgggaagactagtgactgtggttcacctagatcaactctaaagtgctggaatgaggaagatgaggaagagtagtttcctaagtgtcttattattctgtcctgtgaaaataagtctggttttccagatacg

SEQ ID NO: 2557 - DNA, 280 bp, Glycine max
  unsure (1)..(280): unsure at all n locations
gtcgcangcacgcgtacgtaagctcggaattcggctcgaggaagcaatgcttatattttgggtggccaagacaaatcacagaactggcatgtctactctgcttctgcagattctgtaactccatgcgacaatgtttacactctagagatgtgcatgactggcctggatagagagaaagcacaggttttctacaaagaacaatctgcttcagctgccattatgactgttaattctggcattagaaaaattcttccagattctgagatttgtgactttgact

SEQ ID NO: 2558 - DNA, 311 bp, Glycine max
  unsure (1)..(311): unsure at all n locations
gtcgcangcgtacgtaagctcggaattcggctcgagcccagttgggtgagattctaacaccagctgcttgcaccattgtttcttcgctcanaaacgataatgtcgactcctatgttctatctgagtccagcctctttgtttatgcctacaagatcatcatcaaaacctgtggtactactaagctattgcttccaatcccacccatattgaagttcgctgaaatgcttnccttaatgttaagtctgtgaatacaccaggggaagtttcatttccccagtgctcagccatatccccatcgcaattttctgang

SEQ ID NO: 2559 - DNA, 292 bp, Glycine max
  unsure (1)..(292): unsure at all n locations
ctncatgatcgtacgtnagctcggaattcggctcgagggtttttttgttgctctccttcaaactccatctttccaaatcctctctttgcnttgtgttttgatctgcttcctactgcgatagtttctctactgttacatggccatggcggtttccgcaattggttttgaaggtttcgagaaaaggttggaaatatcctttttccagccgggactttttgctgaccctgaaggaaggggtctaagggctcttacaaaatcccagttgggtgagattctaacaccagctgcttgc

SEQ ID NO: 2560 - DNA, 288 bp, Glycine max
  unsure (1)..(288): unsure at all n locations
ggntatgcacncgnacgtgngcncngagttcggcncgnggggggnttccgnaatnggttttgaaggtttcgagaaaaggttggaaatatccttnntccannccgggactttntgctgaccctggnaggaaggggtctacagggctcttacaaaatcccagttgggtgagattctaacaccagctgcttgcaccatgtttcttncntcanaaacgatnntgtcgactcctatgttctatctgagtncagcctctttgtnnatgcctacaagatcatcancnanacctgt

SEQ ID NO: 2561 - DNA, 300 bp, Glycine max
  unsure (1)..(300): unsure at all n locations
tcgcatgcacgcgtacgtaagctcggaattcggctcgagcncantngggngagattcnaanaccagctgcttgcacnantgtttcttcgctcaaaaacnagcaatgtcgactcctatgttctatctgagtccagcctctttgtttatgcctncaagancatcatcaaaacctgggtactactaagctattgcttccaatcccacccatattgaagttcgctgaaatgctttcccttaatgttaagtctgtgaattacaccaggggaagtttcattttccccagtgctcagccatatcccc

SEQ ID NO: 2562 - DNA, 236 bp, Glycine max
  unsure (1)..(236): unsure at all n locations
ncgcgtacgtaagctcggaattcggctcgagcagcattcgttgcggcattttaatcgatttatccaagcaggactgaatgaactaatggagtctaaacncgggaaaaagaagtctagtagtagtagtagtaaatcattgttctacgaagctcccctcggatacagcattgaagacgttagaccaaacggtggaatcaagaaattcagatctgctgcttactccaactgcgctcgcn

SEQ ID NO: 2563 - DNA, 285 bp, Glycine max
  unsure (1)..(285): unsure at all n locations
ncncgtacgtaagctcggaattnggctcgagctcgagncggttcatgtggntngtgcaagcaatttgtntgatcanacgtgnnttctggatgttaagggatactgtcgcgaagagaggagccacgaagggcttggaatgggtggttctcttnncctaccaaaaatttgccaagacttgtgactgtgcgctcacctagatcaactctgaagtgctggaaagaggaagatgaagaagagtagttttcttaagtgtctttattatgtccttgcgaaaataagtccggt

SEQ ID NO: 2564 - DNA, 286 bp, Glycine max
acgtcgcatgcacgcgtacgtaagctcggaattcggctcgagaacttttctgaggaagttgctattcttgatggctactttggcaagcttagtgcaggaagcaatgcttatattttgggtggccaagacaaatcacagaactggcatgtctactctgcttctgcagattctgtaactccatgcgacaatgtttacactctagagatgtgcatgactggcctggatagagagaaagcacaggttttctacaaagaacaatctgcttcagctgccattatgactgttg

SEQ ID NO: 2565 - DNA, 296 bp, Glycine max
  unsure (1)..(296): unsure at all n locations
gtcgcangcacgcgtacgtaagctcggaattcggctcgagngttttggttgattcaaggccttcacagcattcgntgcggcattttnatngatntntccaagcaggactgnatgaactaatggagtctaaaggtgggaaaaagaagtctagtagtagtagtagtanatcattttctacgaagctcccctcggntacagcattgaagangttagaccaaacggtggaatcaagannttcagatctgctgcttactccaactgcgctcgcaaaccttcctgntatccatccagattga

SEQ ID NO: 2566 - DNA, 492 bp, Glycine max
  unsure (1)..(492): unsure at all n locations
ccacgcgtccgcttcaaatcacacactctcttcaatttctagggttttgctattgctttgcctccgttccccngntctcacaaaaacaacgccttttctcttctccttcgtatctattctttgcgtttggtttttggttgattgaaggcattcacagcngtaattcgttgctgcattttaatcgatttatctaaccaggactgaatgacctaatggagtctaaaggtgggaaaaagaagtctagtagtagtagtagtaaatcaattttttacgaagctcccctcggatacagcattgaagacgttagaccaaacggtggaatcaagaaattcagatctgctgcttactctaactgttctcgcaaaccatcctgatacacatccggattgatagttcgttgcatgcaaccatagttttattaggattttttcttctttgntttcaattaggtttttttgttgctctccttcaaactccatctttccaaatcct

SEQ ID NO: 2567 - DNA, 298 bp, Glycine max
gtagcatgcacgcgtacgtaagctcggaattcggctcgagcgtatctattctttgcgtttggtttttggttgattgaaggcattcacagcgtaattcgttgctgcattttaatcgatttatctaaccaggactgaatgacctaatggagtctaaaggtgggaaaaagaagtctagtagtagtagtagtaaatcaattttttacgaagctcccctcggatacagcattgaagacgttagaccaaacggtggaatcaagaaattcagatctgctgcttactctaactgttctcgcaaacc

SEQ ID NO: 2568 - DNA, 277 bp, Glycine max
  unsure (1)..(277): unsure at all n locations
gtcgcngcacgcgtacgtaagctcggaattcggctcganctcgagccgaatcggctcgagaganaaggttggaaanctcctttannccagccgggactttanggctgacnctgaaggaagaggtctaagggctcttacaaaatcccagttgggtgagattctaacaccagctgcttgcaccattgtttcttcgctcaaaaacgataatgtcgactcctatgttctatctgagtccagcctcttgtttatgcctacnagatcatcatcanaacctgtg

SEQ ID NO: 2569 - DNA, 307 bp, Glycine max
  unsure (1)..(307): unsure at all n locations
ngtcgttgtncgcgtacgtnagctcggnattcggctcgagtttgttttcaattaggtttttgtctgctctccttcaaactccgtctttccgaatcctctctttgtgattgtnttctgttctgcttcctaccgcgatagtttctcttctgaagcatggccatggcggtttctgcaattggttttgaaggtttcgagaagaggctggaaatatcctttttccagccgggactttttgctgaccctgagggnatgggtttnagagctcttgcnaagtcccagttggntgagatacttacaccggctgctt

SEQ ID NO: 2570 - DNA, 245 bp, Glycine max
ggtttttgctgctctccttcaaactccgtctttccgaatcctctctttgtgattgtgttctgttctgcttcctaccgcgatagtttctcttctgaagcatggccatggcggtttctgcaattggttttgaaggtttcgagaagaggctggaaatatcctttttccagccgggactttttgctgaccctgagggaatgggtttaagagctcttgcaaagtcccagttggatgagatactacaccgg

SEQ ID NO: 2571 - DNA, 326 bp, Glycine max
  unsure (1)..(326): unsure at all n locations
ncncgcangcacgcgtacgtaagctcggaattcggctcgaggttttctcccaactgagttctctgttgcagttcatgtggatggtgcaagcaagttgtttgatcagacgtgttttctggatgttaagggatactgtcgcgaagagaggagccacgaagggcttggaatgggtggttctcttgtctaccaaaatttgccaagacttgtgactgtggttcacctagatcaactctgaagtgctggnaagaggnagatgcagaagagtagttttcttaagtgtctttattatgtccttgcgaaaataagtccggttttccagacagtga

SEQ ID NO: 2572 - DNA, 281 bp, Glycine max
  unsure (1)..(281): unsure at all n locations
agttgcgcgnacncgtacgtaagctcggaattcggctcgagaaatcattgttctangaagctcccctcgnatanagcatnggngacgttagaccaannggtggaatcaagaaattcagatctgntgcttactccaactgcgctcgcaaanccttcctgatatccatccngattgatagttcattgcatgcaaccatagtttnattaggttttntcttctttgttttcaattaggtttttgctgctctccttcaaactccgtctttccgaatcctctctttg

SEQ ID NO: 2573 - DNA, 298 bp, Glycine max
  unsure (1)..(298): unsure at all n locations
gtcgcangcacgcgtacgtaagctcggaattcggctcgaggttttttcttctttgttttcaattaggtttttgctgctctccttcaaactccgtctttccgaatcctctctttgtgattgtgttctgttctgcttcctaccgcgatagtttctcttctgaagcatggccatggcggtttctgcaattggttttgaaggtttcgagaagaggctggaaatatcctttttccagccgggactttttgctgaccctgagggaatgggtttaagagctcttgcaaagtcccagttggatgag

SEQ ID NO: 2574 - DNA, 450 bp, Glycine max
  unsure (1)..(450): unsure at all n locations
aagggggattctgtangngnnatnggannggacaacatanaagcgctatgacgtcgcatgcacgcgtacgtaagctcggaattcggctcgagtttatgcctacaagatcatcatcaaaacctgtggtacnnntaagctattgcttgcaatcccacccatattgaagttcgctgaaatgctttcccttaatgttaagtctgtgaattacaccaggggaagtntcattttccccagtgctcanccatatcnncatcgcaagntttntgaggaagattnnantgttnttngttantntnncnnnctttttnnatttacttaacttatnatttgnncnttttatntttaagcatnatnactnnanntttttnaggnggggtgtnttntttnttnntctttnttntttttttnnnattcantttattngtttntntnttnntnnnntnttcnttt

SEQ ID NO: 2575 - DNA, 218 bp, Glycine max
  unsure (1)..(218): unsure at all n locations
annttacgnttgaggtcangcacgcgtacgtaagctcggaattcggctcgagnttttgaaggtttcgagaaaaggttggaaatatcctttttccagccgggactttttgctgaccctgaaggaaggggtctaagggctcttacaaaatcccagttgggtgagatnctaacaccanctgcttgnancattgtntcttcgctcaaaaacgataatgtcgn

SEQ ID NO: 2576 - DNA, 428 bp, Glycine max
  unsure (1)..(428): unsure at all n locations
ccacncntccgcaagttgtttgatcagacgtgttttctgnatgttaagggatactgtcgcgaagnggggggccactaagggcttggaatgggtggttctctnagtctaccaaaaatttgccaagacttgtgactgnggttcacctanatcaactctgaagtgctggaaagaggaagatgaanaanagtanttttcttaagtgtctttattatgtccttgcnaaaataagtccngttttncagacagngattgtttntctttggtgttttttnccttttatgttagaccattgttagggcagtttggaccttttattgntctactattaccatttgaacatcgnatggattttaataaaanananataatatnanngaaatttatttcttattattanctttttnatntatttnanttttanaattctn

SEQ ID NO: 2577 - DNA, 312 bp, Glycine max
  unsure (1)..(312): unsure at all n locations
tcgcatgcacgcgtacgtaagctcggaattcggctcgagntaatgtcgactcctatgttctatctgagtccagcctctntgtttatgcctacaagatcatcatcaaaacctgtggtactactaagctatngcttgcaatcccacccatattgnagttcgctgaaatgcttcccttaatgtnaagtctgtgaattacaccaggggaagnntcattttccccagtgcncagccanatnccnatcgcaanttttnngaggnagtcnccattcctggatngcctactttggcaaacttggtgcggangcaatgctt

SEQ ID NO: 2578 - DNA, 261 bp, Glycine max
  unsure (1)..(261): unsure at all n locations
gtcgcatgcagcgtacgtaagctcggaattcggctcgagcagccatatccccatcgcaacttttctgaggaagttgctattcttgatggctactttggcaaacttggtgcaggaagcaatgcttatattttgggtggccaagacaaagcacanaactggcatgtctactctggcttctgcagattctgaactcaatgtgccaatgnttacactcntgagntgnggcatgactggctggatagagagaangcncaggttttc

SEQ ID NO: 2579 - DNA, 279 bp, Glycine max
  unsure (1)..(279): unsure at all n locations
gtcgcatgcacgcgtacgtaagctcggaattcggctcgagtaaaggtgggaaaaagaagtctagtagtagtagtagtaaatcaattttttacgaagctcccctcggntacagcattgaagacgttagaccaaacggtggaatcaagaaattcagatctgctgcttactctaactgttctcgcaaaccatcctgatacacatccggattgatagttcgttgcatgcaaccatagttttattaggatttttctcttgttttcaattaggtttttttgttgc

SEQ ID NO: 2580 - DNA, 234 bp, Glycine max
  unsure (1)..(234): unsure at all n locations
tcgangcacgcgtacgtaagctcggaattcggctcgagaagcaatgcttatattttgggtggccaagacaaagcacagaactggcatgtctactctgcttctgcagattctgtaactcantgtgacaatgtttacactcttgagatgtgcatnactggcctggatagagagaaagcacaggttttcnacaaagaacaatctgcttcagctgccatgatgactgnnaannccggc

SEQ ID NO: 2581 - DNA, 306 bp, Glycine max
  unsure (1)..(306): unsure at all n locations
gcatgcacgcgtacgtaagctcggaattcggctcgagnttcttctttgttttcaattaggtttttttgttgctctccttcaaactccatctttccaaatcctctctttgcgattgtgttttgatctgcttcctactgcgatagtttctctactgttacatggccatggcggtttccgcaattggttttgaaggtttcgagaaaaggttggaaatatccttttccagccgggactttttgctgaccctgaaggaaggggtctaagggctcttacaaaatcccagttgggtgagatctaacaccagcn

SEQ ID NO: 2582 - DNA, 300 bp, Glycine max
  unsure (1)..(300): unsure at all n locations
agtcgcatgcacgcgtacgtaagctcggaattcggctcgangccttcacagcattcgttgcggcattttaatcgatttatccaagcaggactgaatgaactaatggagtctaaaggtgggaaaaagaagtctagtagtagtagtagtaaatcattgttctacgaagctcccctcggtacagcattgaagacgttagaccaaacggtggaatcaagaancttcagatctgctgcttactccaactgcgctcgcaaaccttcctgatatccatccggttgatagttncattgcatgcnacca

SEQ ID NO: 2583 - DNA, 292 bp, Glycine max
  unsure (1)..(292): unsure at all n locations
cgtcgcgtgcncgcgtacgtaagctcggaattcggctcgaggttttattnggattttntcttctttgtnttcaattaggtttttttgttgctctccttacaaactaccatactttccaaatcctctctttgcgattgtgttttgatctgcttcctactgcganagtatcnctactgttacatggccatggcggtnnccgcaattggttttgaaggtttcgagaaaaggttggaaatatccttttnccagccgggactttttgctgaccctgaaggaaggggtctaagggctc

SEQ ID NO: 2584 - DNA, 153 bp, Glycine max
catgcacgcgtacgtaagctcggaattcggctcgagctcagaaatgatcatgtcgactcctatgttctgtctgagtccagtctctttgtttatgcctacaagatcatcatcaaaacctgtggtactacaaagctactgcttgcaatcccaccg

SEQ ID NO: 2585 - DNA, 474 bp, Glycine max
  unsure (1)..(474): unsure at all n locations
tnnaactntacgcgcccaggtaccggtcaaagaattcccgggtcgacccacgcgtcngtacggctgcgagaagacgacagaagggtacggctgcgagaagacgacagaaggggacacgcaactatttctgactacgttttgctctacgcctctccctctctctcaaaaatcgttctcttcgattttagggttttgttttgctgctgcctccgttccccccttctcataaacaacgcgttttctcttctgcttcgtatctattctttgcttttggttttggttgattcaaggccttcacagcattcgttgcggcattttaatcgatttatccaagcaggactgaatgaactaatggagtctaaaggtgggaaaaagaagtctagtagtagtagtagtaaatcattgttctacgaagctcccctcggatacagcattgaagacgttagaccaaacggtggnatcaaagaaattcaa

SEQ ID NO: 2586 - DNA, 80 bp, Glycine max
  unsure (1)..(80): unsure at all n locations
cagccctatccccatcgcaacttttctgaggaagttgctattcttgatggctacttnggcaagcattgctngnnagnggg

SEQ ID NO: 2587 - DNA, 303 bp, Glycine max
  unsure (1)..(303): unsure at all n locations
tcgcatgcanncgtagnaataagctcnanaattcggctcgagggcntggaatgggtggttctctngtntancaaaaacctgccaagacttgtgactgtggttcacctagatcaactctgaagtgctggaaagaggaagatgaagaagagtagttttcttaagtgtctttattatgtcctgcgaaaataagtccggttttccagacagtgattgtttttctttggtgttttttcccttttatgttagaccattgttagggcgtttggaccttttattgttctactattaccattgaacatcgaa

SEQ ID NO: 2588 - DNA, 267 bp, Glycine max
  unsure (1)..(267): unsure at all n locations
ctgcacgcgtacgtaagctcggaattcggctcgagggaaacaagtcgtttgagcagacctgctttctggatgttaagggatactgtncgtgaagagaggagccacgaagggcttggaatgggtggttctgttgtctaccaaaaattcgggaagactantgactgtggtcacctagatcaactctaaagtgctggaatgaggaagatgaggaagagtagtttccttaagtgtctttattattctgtccttgtgaaaataagtctggtt

SEQ ID NO: 2589 - DNA, 225 bp, Glycine max
  unsure (1)..(225): unsure at all n locations
ttcaatttctagggttttgctatacgctttgcctccgttccccctttctcacaaaaacaacgccttttctcttctccttcgtatctattctttgcntttngtttttggttgattgaacggcattcacagcgtaattggtgctgcattttnatcgatttatctaancaggactgantgacctaatggagtctaaaggtgggaaanagaagtctagtagtagtagta

SEQ ID NO: 2590 - DNA, 469 bp, Glycine max
  unsure (1)..(469): unsure at all n locations
tntaactctccngcgcacaggtanacggtatcagagtccccggcctcgacccaagcgtcaagcccacgcgtccgtacggctgcgagaagacgacagaaggggacacgcaactatttctgactacgttttgctctacgcctctccctctctctcaaaaatcgttctctgncgattttagggtttcgttttgctgctgcctccgttccccccttctcataaacaacgcgttttctcttctgcttcgtatctattctttgcttttggttttggttgattcaaggccttcacagcattcgttgcggcattttaatcgatttatccaagcaggactgaatgaactaatggagtctaaaggtgggaaaaagaagtctagtagtagtagtagtaaatcattgttctacgaagctcccctcggatacagcattnaaagaacttnngaccaaacggtggaatcaaggaaattcagatc

SEQ ID NO: 2591 - DNA, 298 bp, Glycine max
  unsure (1)..(298): unsure at all n locations
cacatgcacgcgtacgtaagctcggaattcggctcgaggttttattaggattttntcttctttgttttcaattaggtttttttgttgctctccttcaaactccatctttccaaatcctctctttgcgattgtgttttgatctgcttcctactgcgatagtttctctactgttacatgccatggcggtttccgcaattggttttgaaggtttcgagaaaaggttggaaatatccttttccagccgggactttttgctgaccctgaaggaaggggtctaagggctctacaaaacccagtt

SEQ ID NO: 2592 - DNA, 275 bp, Glycine max
  unsure (1)..(275): unsure at all n locations
anacactctcttgcaatttctagggttttggtattgctttgcctccgttccccctttctcncaaaaanaacgnnttttctcttctccttcgtatctattctttgcntntcgctttnggntgantnaaggcattcanagcgtaattngttnctgcattttnatcgatttctctaancaggnctgantganctaatggagtctaaaggtggganaaagaagtntagtagtantagtagtaaatgcnttttntacgnagctcccctcggatacagcat

SEQ ID NO: 2593 - DNA, 269 bp, Glycine max
  unsure (1)..(269): unsure at all n locations
cgcgnncgtnngctcggaattcggctcgagcgcaaaccatcctgatacacatccggattgatagttcgttgcatgcaaccatagttttattaggattttntcttctttgttttcaattaggtttttttgttgctctccttcaaactccatctttccaaatcctctctttgcgattgtgttttgatctgcttcctactgcgatagtntctctactgttacatggccatggcggtttccgcaattggttttgaaggtttcgagaaaaggtt

SEQ ID NO: 2594 - DNA, 155 bp, Glycine max
  unsure (1)..(155): unsure at all n locations
acgncgcaccnacgcgtacgtaagctcggaattcggctcgaggtggtactacaaagctactgcttgcaatcccacccatattgaaatttgctgaaatgctttccctcaatgttagatctgtgaattacaccaggggaagtttcatctttcccggn

SEQ ID NO: 2595 - DNA, 301 bp, Glycine max
  unsure (1)..(301): unsure at all n locations
naaagtcgcangcacgcgtacgtaagctcggaattcggctcgagttcaaatcacacactctcttcaatttctagggttttgctattgctttgcctccgttccccctttctcacaaaaacaacgccttttctcttctccttcgtatctattctttgcgtttngntttnggttgattganggcattcacagcgtaattngttgctgcattttaatcgatttatctaaccaggactgaatgacctaatggagtctaaaggtgggaaaaagaagtctagtagtagtagtagtaaatcaatttttn

SEQ ID NO: 2596 - DNA, 311 bp, Glycine max
  unsure (1)..(311): unsure at all n locations
gtcgcatgcacgcnaacgtaagctcggaattcggctcgaggattgccttcaaatcacacactctcttcaatttctagggttttgctattgctttgcctccgttccccctttctcacaaaaacaacgccttttctcttctccttcgtatctattctttgcgnttggtttttggttgattgaaggcattcacagcgtaattngttgctgcattttnatcgatttatctaaccaggactgaatgacctaatggagtctaaaggtgggaaaaagaagtctagtagtagtagtagtaaatcaatttattacgaagc

SEQ ID NO: 2597 - DNA, 314 bp, Glycine max
  unsure (1)..(314): unsure at all n locations
ncnnntgcacgcgtacgtaagctcggaattcggctcgaggattgccttcaaatcacacactctcttcaatttctagggttttgctattgctttgcctccgntccccctttctcacaaaaacaacgccttttctcttctccttcgtatctattctttncntttngntttnggttgattgaaggcattcacagcgtaattngttgctgcatttnnatcgatttatctaaccaggactgaatgacctaatggagtctaaaggtgggaaaaagaagtctagtagtagtagtagtaaatcaattttttacgaagctccc

SEQ ID NO: 2598 - DNA, 304 bp, Glycine max
  unsure (1)..(304): unsure at all n locations
cgtacgtaagctcggaattcggctcgagatcacacactctcttcaatttctagggttttgctattgctttgcctccgttccccctttctcacaaaaacaacgccttttctcttctccttcgtatctattctttgcntttngtttttggttgattganggcattcacagcgtaattngttgctgcatttnnatcgatttatctaaccaggactgaatgacctaatggagtctaaaggtgggaaaaagaagtctagtagtagtagtagtaaatcaatcttttacgaagctcccctcggatacagca

SEQ ID NO: 2599 - DNA, 238 bp, Glycine max
  unsure (1)..(238): unsure at all n locations
ctttctgattgccttcaaatcacacactctcttcaatttctagggttttgctattgctttgcctccgttccccctttctcacaaaaacaacgccttttctcttctccttcgtatctattctttgcgtttggtttttggttgattganggcattcacagcgtaattngtngctgcatttnaatcgatttatctaaccaggactgaatgacctaatggagtctaaagnngggaaaaagaa

SEQ ID NO: 2600 - DNA, 274 bp, Glycine max
  unsure (1)..(274): unsure at all n locations
gtacgtnagctcggaattcggctcgagnagaaattcagatctgctgcttactctaactgttctcgcaaaccatcctgatacacatccggattgatagttcgttgcatgcaaccatagttttattaggattttttcttctttgttttcaattaggtttttttgttgctctccttcaaactccatctttccaaatcctctctttgcgattgtgttttgatctgcttcctactgcgatagtttctctactgttacatggccatggcggtttccgcaa

SEQ ID NO: 2601 - DNA, 257 bp, Glycine max
  unsure (1)..(257): unsure at all n locations
caaganattcagatctgctgcttactctaactgttctcgcaaaccatcctgatacacatccggattgatagttcgttgcatgcaaccatagttttattaggatttnttcttctttgttttcaattaggtttttttgttgctctccttcaaactccatctttccaaatcctctctttgcgattgtgttttgatctgcttcctactgcgatagttnctctactgttacatggccatggcggtttccgcaattggntntg

SEQ ID NO: 2602 - DNA, 259 bp, Glycine max
  unsure (1)..(259): unsure at all n locations
acgttttgctctacgcctctccctctctctcaaaaatcgttcncttcgattttagggttttgtttngctgctgcctccgttccccccttctcataaacaacgcgttttctcttctgcttcgtatctattctttgcttttggttttggttgattcaaggccttcacagcattcgttgcggcattttaatcgatttatccaagcaggactgaatgaactaatggagtctaaaggtgggaaaaagaagtctagtagtagtag

SEQ ID NO: 2603 - DNA, 246 bp, Glycine max
  unsure (1)..(246): unsure at all n locations
cgcacctctttctgattgccttcaaatcacacactctcttcaatttctagggttttgctattgctttgcctccgttccccctttctcacaaaaacaacgccttttctcttctccttcgtatctattctttgcgtttggtttttggttgattganggcattcacagcgtaattngttgctgcatttnaatcgatttatctaaccaggactgaatgacctaatggagtctaaaggtgggatanagaag

SEQ ID NO: 2604 - DNA, 310 bp, Glycine max
  unsure (1)..(310): unsure at all n locations
annctcatgcacgcgtacgtaagctcggaattcggctcgagacgttttgctctacgcctctccctctctctcaaaaatcgttctcttcgattttagggttttgttttgctgctgcctccgttccccccttctcataaacaacgcgttttctcttctgcttcgtatctattctttgcttttggttttggttgattcaaggccttcacagcattcgttgcggcattttaatcgntttatccaagcaggactgaatgaactaatggagtctaaaggtgggaaaaagangtctagtagtagtatagtaaatcat

SEQ ID NO: 2605 - DNA, 290 bp, Glycine max
  unsure (1)..(290): unsure at all n locations
acgtcgcangcacgcgtacgtaagctcggaattcggctcgagctacgcctctcctctctctcaaaaatcgttctcttcgatttnagggttttgttttgctgctgcctccgttccccccttnctcataaacaacgcgttttctcttctgcttcgtatctattctttgcttttggttttggttgattcaaggccttcacagcattcgttgcggcattttaatcgatttatccaagcaggactgaatgaactaatggagtctaaaggtgggaaaaagaagtctagtagtagta

SEQ ID NO: 2606 - DNA, 333 bp, Glycine max
  unsure (1)..(333): unsure at all n locations
nanatgnacgcgtacgtaagctcggaattcggctcgagctttctgattgccttcaaatcacacactctcttcaatttctagggttttgctattgctttgcctccgttccccctttctcacaaaaacaacgccttttctcttctccttcgtatctattctttgcgtttggttttcggttgantgaaggcattcacagcgtaattngttgctgcatttnnatcgatttatctaagcaggnctgantgagccaatggngtctaaangtgggaaaaagaagtctagtngtagtagtagtaaatcaattttttacgaagctcccctcggatacagcat

SEQ ID NO: 2607 - DNA, 313 bp, Glycine max
  unsure (1)..(313): unsure at all n locations
gcacgcgtacgtaagctcggaattcggcntcgagngattgccttcaaatcacacactctcttcaatttctagggttttgctattgctttgcctccgttccccctttctcacaaaaacaacgccctttctcttctccttcgtatctattctttgcgtttngctttnggttgactganggcattcacagcgtaattngttgctgcattttnatcgatttatctaancaggactgantgacctaatggagtccaaaggtgggaaaaagaagtctagtagtagtagtagtaaatcaattttttacgaagcncccctg

SEQ ID NO: 2608 - DNA, 286 bp, Glycine max
  unsure (1)..(286): unsure at all n locations
accangcacgcgtacgtaagctcgganttcggctcgagtctacgcctctccctctctctcaaaaatcgttctcttcgattttagggttttgttttgctgctgcctccgttccccccttctcataaacaacgcgttttctcttctgcttcgtatctattctttgcttttggttttggttgattcaaggccttcacagcattcgttgcggcattttaatcgatttatccaagcaggactgaatgaactaatggagtctaaaggtgggaaaannaagtctagtagtagt

SEQ ID NO: 2609 - DNA, 311 bp, Glycine max
  unsure (1)..(311): unsure at all n locations
ncgtcgcangcacgcgtacgtnagctcggnattcggctcgagnnttgctctacgnctctccctctctctcaaaaatcgttctcttcgattttagggtnttgttttgctgctgcctccgttccccccttctcataaacaacgcgttttctcttctgcttcgtnttattctngcgcttttgggatnggttgantnaaggcctncanagcattcgntgcggcattctaatcganttatccaancaggnctgaatnaactantggagtctaaaggnnggacaaagaagtctagtngtngtagnagtaaancattg

SEQ ID NO: 2610 - DNA, 306 bp, Glycine max
  unsure (1)..(306): unsure at all n locations
ngtcnnangcacgcntacgtnagctcggnattcggctcgagntctgactacgttttgctctacgcctctccctctctctcaaaaatcgttctcttacgattttagggtttngttttgctgctgnctccgntccccccttgctcataaacaacgcgttttcncntctgcttcgtatctattctttgcntnnggntttggttgattcaaggccttcacagcattcgtngcggcatttnaatcgatttatccaagcangactgaatgnactaatggagtctaaaggtgggaaaaagaagtctagtagtg

SEQ ID NO: 2611 - DNA, 316 bp, Glycine max
  unsure (1)..(316): unsure at all n locations
gtcgcangcagcgtacgtaagctcggaattcggctcgagcgcctctccctctctctcanaaatcgttctcttcgattttagggtnttgttttgctgctgcctccgttccccccttnctcataaacaacgcgttttctcttctgcttcgtatctattctacgcttttggttttggttgattcaaggccttcacagcattcgttgnggcatttnaatcgatttatccaagcaggactgaatgaactnatggagnctaaaggngggaaaaagcagtntagtagcngtagcagtnacncatgtnntcagnagcncccngc

SEQ ID NO: 2612 - DNA, 329 bp, Glycine max
  unsure (1)..(329): unsure at all n locations
acttcgcatgcacgcgtacgtaagctcggaattcggctcgagctaacaccagctgcttgcaccattgtttcttcgctcanaancnntnaatgtcgantcctatgttctatntgngtccagcctgctttgtttatgtcntanaagatcatcatcgcaacctgtggtnctactangctattgcttgnaatcccacccatattgnngttcgctganatgctttccctgaatgttaagtctgtgaattacaccaagggaagtttcattttnnncatgctcagncatntccccgtcgcaacttttctgaggaagntgctattcttggatggcta

SEQ ID NO: 2613 - DNA, 274 bp, Glycine max
  unsure (1)..(274): unsure at all n locations
agtctcatgcacgcntacgtnnagctcggaattcggctcgagtgcaaccatagttttattaggattttttcttctttgttttcaattaggtttttttgttgctctccttcaaactccatctttccaaatcctctctttgcgattgtgttttgatctgcttcctactgcgatagtttctctactgttacatggccatggcggtttccgcaattggttttgaangtttcgagaaaaggttggaaatatcctttttccagccgggactttttgctga

SEQ ID NO: 2614 - DNA, 275 bp, Glycine max
  unsure (1)..(275): unsure at all n locations
tcgcatgcacgcgtacgtaagctcggaattcggctcgagctttctgattgccttcaaatcacacactctcttcaatttctaggnttttgctattgctttgcctccgttccccctttctcacaaaaacaacgccttttctcttctccttcgtatctattctttgcgtttggtttttggttgattgaaggcattcacagcgtaattngttgctgcattttaatcgatttatctaaccaggactgaatgacctaatggagtctaaagntgggaaaaag

SEQ ID NO: 2615 - DNA, 302 bp, Glycine max
  unsure (1)..(302): unsure at all n locations
ncgcangcacgcgtacgtaagctcggaattcggctcgagntgccttcaaatcacacactctcttcaatttctagggttttgctattgctttgcctccgttccccctttctcacaaaaacaacgccttttctcttctccttcgtatctattctttgcgcttggcttaggntgactganggcattcacagcgtaattcgttgctgcattttaatcgatttatctaaccaggnctgantganctantgggctctaaaggtgggaaaaagaagtctaagtagtagtagagtaaatcaantnnccnc

SEQ ID NO: 2616 - DNA, 294 bp, Glycine max
  unsure (1)..(294): unsure at all n locations
cgnangcacacgtacgtaagctcggaattcggctcgagntttagggttttgttttgctgctgcctccgttccccccttctcataaacaacgcgttttctcttctgcttcgtatctattctttgcttttngttttggttgattcaaggccttcacagcattcgttgcggcattttaatcgatttatccaagcaggactgaatgaactaatggagtctaaaggtgggaaaaagaagtctagtagtagtagtagtaaatcattgttctacgaagctcccctcggatacagcattgaa

SEQ ID NO: 2617 - DNA, 320 bp, Glycine max
  unsure (1)..(320): unsure at all n locations
actnnaagtcgcatgcacgcgtacgtaagctcggaattcggctcgagctttctgattgccttcaaatcacacactctcttcaatttctagggttttgctattgctttgcctccgttccccctttctcacaaaaacaacgcctttnntcttctccttcgtatctattctttgcgnntngntntnggttgattganggcattcacagcgtaattngttgctgcatttnaatcgatttatctaaccaggactgaatgacctaatggagtctaaanntggggaaaangaagtctagtagtagtagtagtaaatcaatttntacg

SEQ ID NO: 2618 - DNA, 260 bp, Glycine max
  unsure (1)..(260): unsure at all n locations
ncntcgcatgcacgcgtacgtaagctcggaattcggctcgaggttccccccttctcataaacaacgcgttttctcttctgcttcgtatctattctttgcttttggttttggttgattcaaggccttcacagcattcgttgcggcattttaatcgatttatccaagcaggactgaatgaactaatggagtctaaaggtgggaaaaagaagtctagtagtagtagtagtaaatcattgttctacgaagctcccctcggatac

SEQ ID NO: 2619 - DNA, 285 bp, Glycine max
  unsure (1)..(285): unsure at all n locations
nagtcgcatgcacgcgtacgtaagctncggaattcggctcgaggctctacgcctctccctcnatctcaaaaatcgtgctcttcgattttagggttttggnttgctgctncctccgttcnccccttctcataaacaacgncgttttctcttctgnttcgtatctattctttgcttttggttttggttgattcaaggccttcacagcattcggtgcggcattttaatcgatttatccaagcaggactgaatgaactaatggagtctaaaggtgggaaaaagaagtct

SEQ ID NO: 2620 - DNA, 304 bp, Glycine max
  unsure (1)..(304): unsure at all n locations
atacgcatgcacgcgtacgtaagctcggaattcggctcgagatttctgactacgttttgctctacgcctctccctctctctcaaaaatcgttctcttcgattttagggttttgttttgctgctgcctccgttccccccttctcataaacaacgcgttttctcttctgcttcgtatctattctttgcttttggttttggttgattcaaggccttcacagcattcgttgcggcattttaatcgatttatccaagcaggactgaatgaactaatggantcnaanggtgggaaaaagaagtctagtag

SEQ ID NO: 2621 - DNA, 405 bp, Glycine max
  unsure (1)..(405): unsure at all n locations
gcttctgtccatccctgtcattctcaagttggctgatgctcttgacatagctgtgaaatctgtgaggtacactcgtggaagcttcattttccctggggcacagtcttttcctcaccgcagtttttccgaggaggtttctgttcttgacagctatttcagcaaccttggttctggtagcaaagcatatgttatgggtgacccttcaaagtcacagatttggcacatctactctgcaagtgcacagaccaaaggatcatctgaagctgtctatggcctagagatgtgcatgaccggtttagacaaggaaagtgcttctgtgtttttcaaggagaatacatcttcagcagcttcaatgaccgaaaattctggaattangaagattcttccacagtctgatatatctga

SEQ ID NO: 2622 - DNA, 299 bp, Glycine max
  unsure (1)..(299): unsure at all n locations
gtcgcatgcacgcgtacgtaagctcggaattnggctcgagctcgagccgccctgtcattctcaagttggctgatgctcttgacatagctgtgaaatctgtgaggtacactcgtggaagcttcattttccctggggcacagtcttttcctcaccgcagtttttccgaggaggtttctgttcttgacagctatttcagcaaccttggttctggtagcaaagcatatgttncgggtgacccttcaaagtcacagatttggcacatctactctgcaagtgcacagaccaaaggatcatctgaa

SEQ ID NO: 2623 - DNA, 200 bp, Glycine max
  unsure (1)..(200): unsure at all n locations
ngtacgtaagctcggaattnggctcgagnntcaagttgggntgatgctcttgacatagctgtgaaatctgtgaggtacactcgtggaagcttcattttccctggggcacagtcttttcctcaccgcagtttttccgaggaggtttctgttcttgacagctatttcagcaaccttggttntggtagcaaagcatatgttat

SEQ ID NO: 2624 - DNA, 328 bp, Glycine max
  unsure (1)..(328): unsure at all n locations
gtnncatgcacgcgtacgtaagctcggaattcggctcgagctgagaatgggatggtgagtagtgagggtgaaaccagtttcacttgtgtcatgaagtttggtggctcctctgtggcttctgctgataggatgaaagaggtggctacccttatattgagttttcccgaggagaggcctattgttgttctctctgctatgggaaaaacaacaaacaagcttttgctggctggagagaaagctgtgagttgtggtgttatcaatgtatcaagtattgaggagctttgctttataaaagacctgcatctaaggactgtggatcagcttggtg

SEQ ID NO: 2625 - DNA, 254 bp, Glycine max
caaatgcggacattttggaagcaacttatccggcagtcgccaagagattacatggtgattggctctctgatcctgcaattgcaattgttacaggcttccttggaaaggcccagaaatcatgtgcagtgacaacactgggtagagggggcagtgatttgacagctacagcaattgggaaagcactagggttacctgagatccaggtatggaaggatgttgatggtgtcctaacctgtgatccaaatatataccca

SEQ ID NO: 2626 - DNA, 297 bp, Glycine max
  unsure (1)..(297): unsure at all n locations
gagtcgcangcacgcgtacgtaagctcggaattcggctcgagcaatattcgaagagttaggtatatcagttgatgttgtagctacaagtgaagttagtatttccttgacattggatccatcaaagctatggagcagagaactaattcaacaggaacttgactatgttgtcgaagaactggaaaaaattgcagtagtaaatctcttaaagaccagatccataatctctctcattggaaatgttcagagatcatcactaatattggagaaggcctttcatgttcttcgaactcttgggg

SEQ ID NO: 2627 - DNA, 299 bp, Glycine max
  unsure (1)..(299): unsure at all n locations
gtcgcangcacgcgtacgtnagctcggaattcggctcgaggtggtgttactaatgtgtcaagtattgaggagctttgctttataaaagatctgcatctaaggnctgtggatcagcttggtgtggacggatctgttattgcaaagcatctagaagaattggagcaacttctgaaggggatagctatgatgaaagaattgactaaaaggactcaggactatttagtctccttggagaatgcatgtcgactaggatcttgctggcatatcttaacaaaataggtgtcaaggccgccatacga

SEQ ID NO: 2628 - DNA, 286 bp, Glycine max
  unsure (1)..(286): unsure at all n locations
tncacgcgtacgtaagctcggaattcggctcgagcagatatgatgtatgaccttatccacaaggctcaatcaanagatgagtcttatacagctgcattaaatgctgttttggagaagcacagtgcaactgcacatgacatacttgancggagataatcttgctactttcttgtctaaattgcatcatgatattagtaaccttaaggcgatgcttcgtgcaatatacatagctggtcatgcaacagagtccttacagattttgttgtgggacatggagaataggtct

SEQ ID NO: 2629 - DNA, 289 bp, Glycine max
  unsure (1)..(289): unsure at all n locations
gtcgcgtacgtnagctcggaattcggctcgagcaggcctcaaccctgaaagaagaattcaacattgatttgcgtgtaatgggcatacttggttcanagtcaatgcttcttagtgatgtgggcattgacttagctagatggagagaacttcgagaggaaagaggagaagtggctaatgtggaaaaatttgttcaacatgtacatggaaatcattttataccaaacacagcattagtggactgcacagctgactctgccattgctggctattactatgactggttgcgcaa

SEQ ID NO: 2630 - DNA, 168 bp, Glycine max
  unsure (1)..(168): unsure at all n locations
angcacgcgtacgtnagctcggaattcggctcgagngcaaatggatggatacaagggatgtccttatcgtaaatcctactggttctaatcaagttgatcctgactatttggaatctgagcaaagacttgaaaaatggtactctttgaatccatgtaaggtaatcattg

SEQ ID NO: 2631 - DNA, 207 bp, Glycine max
  unsure (1)..(207): unsure at all n locations
gtcgcatgctcgcgtacgtgggnncggggntnnnnnnanttnncatacttttggtgctcnggtcctgcatccncngtctatgagacctgctanagaaagtgatattcctgttagggttaaaaattcctacaaccctaaagctccaggtactctcnttgctnnngacgngggatatggncagggctttttnacctnccttttttggag

SEQ ID NO: 2632 - DNA, 293 bp, Glycine max
  unsure (1)..(293): unsure at all n locations
gtcgcangcacgcgtacgtnagctcggaattcggctcgagggtggctttgcggatattgaaacgagttacacgtgtgtcatgaagtttggcggctcctctgttgccaatgcagaaaggatgagagaggttgccaaccttattctgagcttcccggaagagaggcctataattgtnctctctgccatgggaaagacaactaacatgctgttgctggctggagaaaaagctgtaagctgtggnataactanggnngatagtttgacgnannggttttnaaaaattggnatccggg

SEQ ID NO: 2633 - DNA, 270 bp, Glycine max
gtagatgtgaaacctggtgtgtccttggaggaaaaacaactacccaaaggagaaacttggtctgttcacaaatttggtggaacctgtgtgggaacctctcaaagaataaaaaatgttgctgacataattcttaaggatgattcggggagaaaattggtggttgtctctgcaatgtcaaaggtgaaaaatatgatgtatgaccttatccacaaggctcaatcacgcgatgagtcttatatagctgcattggattctgtttaggagaagcac

SEQ ID NO: 2634 - DNA, 313 bp, Glycine max
  unsure (1)..(313): unsure at all n locations
nncacncgcacgcacgcgtacgtaagctcggaattcggctcgagcccggaaatcatgtgcagtgacaacactgggaagagggggcagtgatttgacggctacaacaattgggaaagcactagggttgcctganatccaggtatggaaggatgttgatggtgtcctaacctgtgatccaaatatatacccaaaagcagaacctgttccttatttgacatttgatgaggctgcagaactagcttactttggtgctcaggttctacatccacagtctatgagacctgccagagaaagtgatattcctgttagggtt

SEQ ID NO: 2635 - DNA, 322 bp, Glycine max
  unsure (1)..(322): unsure at all n locations
gtcgcangcatcgtacgtnagctcggaattcggctcgagntaaaaggactcaggactatttagtntcctttggagaatgcatgtnnacaaggatctttgcnggnacatncgnaanaaaataggtgtcaaggctcgccaatatgatgcatttganattggttttataancaactgacgacttcacanatgcggacattttggnngccacttatccagctgttgcanagagnttgcatggtnantagctctccgctcctgcaattgcaattgcnacggctccttggaaaggcccggaactcangtgcantnccaacactgggac

SEQ ID NO: 2636 - DNA, 310 bp, Glycine max
gtcgcatgcacgcgtacgtaagctcggaattcggctcgagctacaagtgaagtcagtgtttccttgacattggatccatcaaagctatggagcagagagctaattcagcaggaacttgaccatgttgtagaagaactcgagaaaatcgctgtggtgaatctcctgcagaatagatccatcatctctctcattggaaatgttcagagatcatcactaatattggagaaggttctgtattatgctccctttatttaaattagttcatatcctaactttcacttatgtataaagatttactgaatttattaca

SEQ ID NO: 2637 - DNA, 438 bp, Glycine max
  unsure (1)..(438): unsure at all n locations
ccacgcgtccgtcccaaatctggaagaatatcttgggaagcaggtcttagaggctgtttcattgattgaagttagaaggcacttcattgaagcattatccagtccgtttggaaggccagttgaagctgatgctgtcttttgcaggaaggcaacttttcttgctgcatctggtgttttcacgttcctgaagcagaagaaataccgtgtgacagaaatgttgggatccaattgcaagatatgggacttgagttccacattggaagtaatgagattctaatgtgggttttataagaccttgggctctctgactacaatgattagcttttgtggtatgattcactcaaagttcttatcaattggtattagagcttttcattatgtctntcaactncaaaacancnacntgggtgaataccttcaaatttgnactgttnaagt

SEQ ID NO: 2638 - DNA, 329 bp, Glycine max
  unsure (1)..(329): unsure at all n locations
tgcangcacgcgtacgtaagctcggaattcggctcgagnttactcctaacaagaaggcaaattcaggaccacttgatcagtatttgaagttaagagctcttcaaaggcaatcctatacacattacttctatgaagcaactgtcggagctggtcttccaattgttagcactttacgtggcctccttgaaactggagacaaaatattacaaatcgaaggcatctttagtgggactttgagttacatatttaataactttaaagatggccgggcttttagtgaggtagtttctgaagcaaaggaagcaggttatactgagccagatccaaga

SEQ ID NO: 2639 - DNA, 256 bp, Glycine max
cagtatttgaagttaagagctcttcaaaggcaatcctatacacattacttctatgaagcaactgttggagctggtcttccaattgttagcactttacgtggcctccttgaaactggagacaaaatactgcaaatcgaaggcatctttagtgggactttgagttacatatttaataacttcaaagacggccgggcttttagtgaggtagtttctgaagcaaaggaagcaggttatactgagccagatccaagagatg

SEQ ID NO: 2640 - DNA, 285 bp, Glycine max
  unsure (1)..(285): unsure at all n locations
gtcgnnntnngggtacgtgagctcggnattcggctcgaggggcagtattaacaagcattgttttgaaacgtaatgtgaccatgttggatatagcaagcactcgcatgcttggtcngtatggtttccttgctaaggngttttcaatctttgaagagttaggcatatcagttgatgttgtagctacaagtgaagtcagtgtttccttgacactggnnccatcaaagctatggagcagagagctaattcagcaggcaagtgaacttgaccatgttgtagaagaactcg

SEQ ID NO: 2641 - DNA, 282 bp, Glycine max
  unsure (1)..(282): unsure at all n locations
cgcngcnttgtacgtnagctcggnattcggctcgagggcagtattaacaagcattgttttgaaacgtaatgtgaccatgttggatatagcaagcactcgcatgcttggtcagtatggtttccttgctaaggtgttttcaatctttgaagagttaggcatatcagttgatgttgtagctacaagtgaagtcagtgtttccttgacactggatccatcaaagctatggagcagagagctaattcagcaggcaagtgaactgaccatgttgtagaagaactcgag

SEQ ID NO: 2642 - DNA, 527 bp, Glycine max
  unsure (1)..(527): unsure at all n locations
gnngnnaggctgnntttnggaannnnnnnnnnnnnnnnnnnnnnnnnnnnnnnnnnnnnnnnnnnnnnnnnnnnnnnnnnnnnnnnnnnnnncgagcaataattgttctctctgccatgggaaagacaactaacatgcttttgctggctggagaaaaagctgtaagctgtggagtaactaatgctgatagtattgatgagctcaacatagtaaaagatcttcatctcaggactgtggaacagcttggagtggacagaaatgttattgagaagcatctagaagaattggagcaacttctaaaggggatagctatgatgaaagagttgactccacggactcaagactatttagtttcatttggagagtgcatgtccactaggatatttgctgcatatcttaatacattaggagttaaggcccgccaatatgatgcatttgagatgggtattataacaactgatgacttcacaaatgctgacattttggaagcaacatatcctgctgttgcaaaaaggttcataantgat

SEQ ID NO: 2643 - DNA, 291 bp, Glycine max
  unsure (1)..(291): unsure at all n locations
nttcgcangcacgcgtacgtaagctcggaattcggctcgaggttgccaaccttattctgagcttcccggaagagaggcctataattgttctctctgccatgggaaagacaactaacatgctgtngctggctggagaaaaagctgtaagctgtggagtaactatggctgatagtattgacgagctcagcattataaaagatctgcatctcaggactgtggaagagcttggagtggacagaaatgctattgagaagcatctagaagaattggagcaacttttaaaggggatag

SEQ ID NO: 2644 - DNA, 265 bp, Glycine max
  unsure (1)..(265): unsure at all n locations
tcgcatgcacgcgtacgtaagctcggaattcggctcgaggaaagaatgagagaggttgccaaccttattctgagcttcccggaagagaggccaataattgttctctctgccatgggaaagacaactaacatgcttttgctggctggagaaaaagctgtaagctgtggagtaactaatgctgatagtattgatgagctcaacataatanaagatcttcatctcaggactgtggaacagcttggagtggacagaaatgttattgaga

SEQ ID NO: 2645 - DNA, 307 bp, Glycine max
  unsure (1)..(307): unsure at all n locations
cangcacgcgtacgtnagctcggnattcggctcgagcaagcactcctggtgttagtgcctcccttttcaatgcattggctaaggccaatataaatgtccgtgctatagcgcaaggttgttctgagtacaatattactgttgttgttaagcgagaggattgtataaaggctttacgagctgtccattccanattttatctctcaagaaccaccatagcaatgggcattattggacctggattaattgggagcacactacttgaccagctaagggatcaggcctcaaccctgaaagaagaattcaacat

SEQ ID NO: 2646 - DNA, 327 bp, Glycine max
  unsure (1)..(327): unsure at all n locations
nngnngcanncacgcgtacgtnagctcggaattcggctcganntccgtgctatagcgcaaggntgttctgagtacaatattactgttgttgttaancgagaggnttgtataaaggctttacgagctgtccattccagatttnatctctcaagaaccaccatagcaatgggcattattggacctggattaattgggagcacactacttgaccagctanaggatcaggcctcaaccctgaaagaagaattcancattgatttgcgtgtaatgggcatacttggttcaaagtcaatgctcttagtgatgttggcattgacttnncctagn

SEQ ID NO: 2647 - DNA, 317 bp, Glycine max
  unsure (1)..(317): unsure at all n locations
ngtnggnntacgtnagctcggaattcggctcgagcggatctgttatttcaaagcatctagaagaattggagcaacttctgaaggggatagctatgatgaaagaattgactaaaaggactcaggactatttagtctcctttggagaatgcatgtcgacaaggatctttgctgcatatcttaataaaataggtgtcaaggctcgccaatatnatgcatttgagattggttttataacaactgacgacttcacaaatgcggacattttggaagcnacttatncagctgttgcaaagagattgcatggtgattggctctcc

SEQ ID NO: 2648 - DNA, 334 bp, Glycine max
  unsure (1)..(334): unsure at all n locations
tcgcangcacgcgtacgtaagctcgggaattcggctcgagctcatttccagagcatctagaagaattggagcaacttctgaaggggatagctatgatgaaagaattgactaaaaggactcaggactatttagtctcctttggagaatgcatgtcgacaaggatctttgctgcatatcttaataaaataggtgtcaaggctcgccaatatgatgcatttgagattggttttatagcaactgacgacttcacaaatgcggncattttggaagcaacttatccagctgttgcaaagagattgcatggtgattggctctccgatcctgcaattgcaat

SEQ ID NO: 2649 - DNA, 286 bp, Glycine max
  unsure (1)..(286): unsure at all n locations
ngcacgcgtacgtaagctcggaattcggctcgngnnatgtccctccgcgagancggcccctccatcgccgtcgtgggcgtcatcggcgccgncggccaggagttcctactccgtcctctccgaccgcgacttcccctaccgctccntcatatgctggcttccaagcgctccgctggccgccgcatcaccttcgaggacagggactacgtcgtccaggagctcacgccggagagcttcgacggtgtcgcatcgcgctcttcagcgccggcggctccatcagcaagca

SEQ ID NO: 2650 - DNA, 280 bp, Glycine max
  unsure (1)..(280): unsure at all n locations
gtnnangcacgcgtacgtaagctcggaattcggctcgaggacgctccggtgggcgccgcatcacctttnagnnccagggactacgtcgtgncggagctgacggcggagancttcgatggcgtcganatcgcgatctncancgccgncggcncccattagcaagtacttcngccccatcnncgtcnatcggggaacggtgntcgncgacancagatccgcntntcggatggacnanaatgtcccattggtaatncccgaatcaaacccgtnnccatgcaaa

SEQ ID NO: 2651 - DNA, 323 bp, Glycine max
  unsure (1)..(323): unsure at all n locations
ncacgcgtncgtanacgtnngnattcngctcgannngcgnnnngctggggcgccgcatcacctttgagtnacagggactacgtcgtggaggagctgacggcggagagcttcgatggcgtcgacatcgcgctcttcagcgccggcggctccattagcaagtacttcggccccatcgccgtcgatcggggaacggtggtcgtcgacaacagctccgcgtttcggatggacgagaatgtcccattggtaattcccgaagtgaacccggaagcaatgcaaaacatcaaagccggaatggaaagggcgcattcatgctaaccctaatt

SEQ ID NO: 2652 - DNA, 402 bp, Glycine max
  unsure (1)..(402): unsure at all n locations
gggaataaaacctgctttctatttttctcaacctaaaatcccatccaccaaccttatgatgatgtcttcactctctgtttcgcgccacaaccacctcttctcgggccctctcccggcccggcccaagcccaagcccagcttttcctcttccaggatccgaatgtccctccaagaaaacggcccctccatcgccgtcgtgggcgtcaccggcgccgtcggccaggagttcctctccgtcctctccgaccgcgacttcccctacagctccatcaaaatgctcgcgtccaagcgctccgctgagcgccgcatcacctttgaggacagggactacgtcgtggaggagctgacggcggagaacttcgatggcgtcgacatcgcgctcttcancgccgggcggctcaa

SEQ ID NO: 2653 - DNA, 482 bp, Glycine max
  unsure (1)..(482): unsure at all n locations
gggnngggnnnnnnttaactttccagggcccggtcaggaaaacccgggtcgacccacgcgtcngtacggctgcgagaagacgacagaagggggggacatggaattggaagacaagttggagtgtggtggtctgttttaaaatccaacacttaatctctctcttcgcagcctaaaatcccaatggcttcactctctgttttgcgccacaaccacctcttctcgggccccctcccggcccgccccaagcccacctcctcctcctcctccaggatccgaatgtccctccgcgagaacggcccctccatcgccgtcgtgggcgtcaccggcgccgtcggccaggagttcctctccgtcctctccgaccgcgacttcccctaccgctccattcatatgctggcttccaagcgctccgctggccgccgcatcaccttcgangacaaggactaagtcgtccaagaactcangccggganaacttcaacg

SEQ ID NO: 2654 - DNA, 327 bp, Glycine max
  unsure (1)..(327): unsure at all n locations
cangcacgcgtacgtaagctcggaattcggctcgagctctcttcgcagcctaaaatcccaatggcttcactctctgttttgcgccacaaccacctcttctcgggccccctcccggcccgccccaagcccacctcctcctcctcctccaggatccgaatgtccctccgcgagaacggcccctccatcgccgtcgtgggcgtcaccggcgccgtcggccaggagttcctctccgtcctctccgaccgcgacttcccctaccgctccattcatatgctggcttccaagcgctccgctggccgccgcatcaccttcgaggacagggactac

SEQ ID NO: 2655 - DNA, 312 bp, Glycine max
  unsure (1)..(312): unsure at all n locations
gtngcccncacgcgtacgtaagctcggaattcggctcgaggagctttgccacaagaaggggactttgctctgtattgatggtacatttgcaacaccattgaaccagaaggcccttgcccttggcgctgatctgattctgcactccttaacaaaatacatgggtggacatcatgatgtaagttggcatgttcaagatttagtttgatggaaaaacaacacaaatatgttacattttcagggttaagagttaagcgtcaaggagcattttcctctttcaggcccttggtggttgcataagtggttcaactaagg

SEQ ID NO: 2656 - DNA, 542 bp, Glycine max
  unsure (1)..(542): unsure at all n locations
gnnnangtnnntntcnaanangntaanctttnnaaaccctccatttnggtaancnccggggccacgcgtccgcncacgcgtncgcccacgcgtccggagagaaagagagggagtaagtgggtnnagganggaaaactaaagaaacaaacctaacacaacacaaatccttgaaacgacgacggaaatggccgtttcgagctcgcacatgcgtttcacctttgagtgccgctccgatcccgatttctcgccccccccgccgtccttcgacaacctccgccgccgaaacttccgctcctccgcaggatccggcgcggcgtttcacggcatctcctccctcatcctccgcttcctcccaacttccagcgccagctaagcaccaaggcgcgccgcaactgcagcaacatcggcgtcgcgcaaatcgtcgccgcttcgtggtcgaacaacagcnacaactnttcggccgncggggcttcngcgccgaccggggncaccggcacggacccggtacggggcttttcccgtngtcgtaacgncnaacaagg

SEQ ID NO: 2657 - DNA, 306 bp, Glycine max
  unsure (1)..(306): unsure at all n locations
cgtcgcangcacgcgtacgtncagctcggaattcggctcgagcggatcttgacatggttgatgctgccatagtagaagggaaaacaaaagtgctttacttcgaatctgtttccaaccccacccttacggttgcgaacatacctgaactgtgccacatggcacaccggaagggagtgacggtggtggtggacaacacgttcgcgcccatggtgctttcgccagcgcgtcttggtgctgatgttgtcgttcacagtatctccaagttcatcagcggtggggccgatatcattgcaggagcggtgtgcg

SEQ ID NO: 2658 - DNA, 307 bp, Glycine max
gtcgcatgcacgcgtacgtaagctcggaattcggctcgaggacggatcttgacatggttgatgctgccatagtagaagggaaaacaaaagtgctttacttcgaatctgtttccaaccccacccttacggttgcgaacatacctgaactgtgccacatggcacaccggaagggagtgacggtggtggtggacaacacgttcgcgcccatggtgctttcgccagcgcgtcttggtgctgatgttgtcgttcacagtatctccaagttcatcagcggtggggccgatatcattgcaggagcggtgtgcgg

SEQ ID NO: 2659 - DNA, 515 bp, Glycine max
  unsure (1)..(515): unsure at all n locations
gnnnngnagagtttgnttggggggnagggagnnanattttnagaccactatgacgtcgcatgcacgcgtacgtaagctcgganttcggctcgagagacagaggntagagaangagagggagtaagtgggtaaaggaaaganaactaaagaaacaaacctaacacaacacaaatccttgaaacgacgacggaaatggccgtttcgagctcgcacatgcgtttcacctttgagtgccgntccgatcccgatttctcgccccccccgccgtccttcgacaacctccgccgccgcaacttccgctcctccgcaggatcccggcgcggcgtttcacggcatctcctcctcatcctncgcttccctcccaacttccagcgccagctaagcaccaaggcgcgccgcaactgcagcaacatcggcgtcgcgcaaatcgtcgccgcttcgtggtcgaacaacagcgacaactctccggccggcggggcttcggcgccggccgcggcaccggcacggacgccgtt

SEQ ID NO: 2660 - DNA, 258 bp, Glycine max
  unsure (1)..(258): unsure at all n locations
caaggacatcatgatgtccttggtggttgcataagtggttcaattnnngtggtttcgcaaattcggactttgcaccatgtnttgggtggtacacttaacccgaatgctgcatacctattcatcagaggcatgaaaacgctgcatctccgtgtacagcagcagaattcaacaggaatgaggatggccaaacttttagaggcacatcccaaggtgaagcgggtctactatccaggcttgccgagtcaccctgaacatgag

SEQ ID NO: 2661 - DNA, 277 bp, Glycine max
  unsure (1)..(277): unsure at all n locations
ganattgtcatgcactctgctacaaaatttattgctggacatagtgacattatggctggtgtgcttgctgtgaagggtgaaaagttgggaaaggaattgtatttcttgcaaaatgcagagggttcaggcttagcaccatttgactgttggctttgtttgcgaggaatcaagacaatggccctgcgaattgaaaaacaacaggataatgcacagaagattgctgagttccttgcctcccatcctcgagtgaagaaagtgaattatgctggcttgcctg

SEQ ID NO: 2662 - DNA, 322 bp, Glycine max
  unsure (1)..(322): unsure at all n locations
gcatgcacncgtacgtaagctcggaattcggctcgagnttgcctcccatcctcgagtgaagaaagtgaattatgctggctngcctggtcatcctggtcgtgatttacactattctcaggcaaagggtgcaggatctgtgcttagcttcttgactggttcattggaactttcaaagcatattgttgaaactaccaaatacttcagtataaccgtcagctttgggagtgtgaagtcccttattagcatgccatgctttatgtcacatgcaagcnngncngctggcagttcgtgaggccagagtttaagaagatctgtagtatat

SEQ ID NO: 2663 - DNA, 273 bp, Glycine max
  unsure (1)..(273): unsure at all n locations
cgcangcacgcgtacgtaagctcggaattcggctcgagaaacaacaggataatgcacagaagattgctgagttccttgcctcccatcctcgagtgaagaaagtgaattatgctggcttgcctggtcatcctggtcgtgatttacactattctcaggcaaagggtgcaggatctgtgcttagcttcttgactggttcattggaactttcaaagcatattgttgaaactaccaaatacttcagtataaccgtcagctttgggagtgtgaagtccc

SEQ ID NO: 2664 - DNA, 289 bp, Glycine max
gcacgcgtacgtaagctcggaattcggctcgaggttcaggcttagcaccatttgactgttggctttgtttgcgaggaatcaagacaatggccctgcgaattgaaaaacaacaggataatgcacagaagattgctgagttccttgcctcccatcctcgagtgaagaaagtgaattatgctggcttgcctggtcatcctggtcgtgatttacactattctcaggcaaagggtgcaggatctgtgcttagcttcttgactggttcatggaacttcaaagcatattgttgaaa

SEQ ID NO: 2665 - DNA, 499 bp, Glycine max
  unsure (1)..(499): unsure at all n locations
aacttttacgccnccangtgccgggcaanggtnangagntcccgggtcgacncacgcgtccggcnagaagacgacagaaggggacggtggtggtggacaacacgttcgcgcccatggtgctttcgccagcgcgtcttggtgctgatgttgtcgttcacagtatctccaagttcatcagcggtggggccgatatcattgcaggagcggtgtgcggacccgcaagactggtgaacgcaatgatggatctgcaacaagggtcactaatgctgctgggtccaacaatgaatgcgaaagtggcattcgaactctcggagagaataccgcacctagggctaagaatgaaggagcatagcaaccgcgcactagagttcgcaacgaggctcaaaaggctaggaatgagggtaatatacccgggcctggaggagcacccacagcaccaagcttctgaaatcaatgcacaacaaggactatggctacggcgggctcatgttcntngaca

SEQ ID NO: 2666 - DNA, 326 bp, Glycine max
  unsure (1)..(326): unsure at all n locations
tcgcatgcacgcgtacgtaagctcggaattcggctcgagacgggaggtcaagcccgccctgaccaacatggtctccgctgctaagctcattcgcacccagctcgccagcgccaagtgagcacctttttttgcctttttcgtttccgaggagggcgtcgtcgatgccaatttgtntccaataaacagggctccccccctgtgcccgccgttctgttgtgctccgtctgtggttaggttactagttttcttgatctcgcccccacgcggtacctgttttatatctgtttggtggtttctgaggcaagttgcccgtgtattgtatcgta

SEQ ID NO: 2667 - DNA, 308 bp, Glycine max
  unsure (1)..(308): unsure at all n locations
agtcgcangcacgcgtacgtaagctcggaattcggctcgagggacactactcagattcacactcacatgtgctactccaacttcaatgacatcattcactcaatcatagacatggatgctgatgtgatcaccattgagaactccagatcagatgagaagttactttcggtcttccgtgagggagtgaaatatggtgccggcattggtcctggcgtttatgatattcactcacccaggattcctcccacagaagaaattgctgacaggatcaacaagatgcttgcagttcttgaaagcagcattctctg

SEQ ID NO: 2668 - DNA, 313 bp, Glycine max
  unsure (1)..(313): unsure at all n locations
nagtcgcacgcacgcttacgtaagctcngaattcggctcnnnngnccantgancttgctgcttctctcantaccttggcagggtcttgagggcattggtgggcaaagataagcttgttggtgtccacctnctcctcccttcttcacactggctgtggntctagttaacganaccnagttggatgatgagatcaagtcatggctagctttggctgcccaaaaaattgttgangttaacgcatnggctaaagcngtgtcnggccacaaggatgaggcctncttctctgntantgcngctgctctggcttcaagan

SEQ ID NO: 2669 - DNA, 290 bp, Glycine max
  unsure (1)..(290): unsure at all n locations
cgcangcacgcgtacgtaagctcggaattcggctcgagggggatgtacttgatcccanncaccagccatctgctcgacgccaccgccancctcggtgccgtcccccccaggtacggctggaccggcggcgagattggattcgncacctacttctccatggccagaggtaatgctaccgtgcntgctanggagatgaccaagtggttcgacaccaactaccactttattgtccctgaattgggccctgatgtgaattcacctatgcttctcacaaggctgttgatgaatac

SEQ ID NO: 2670 - DNA, 289 bp, Glycine max
  unsure (1)..(289): unsure at all n locations
cncgcacgcgtacgtaagcntcgcgaattcggctncgagttgctcccncagnagcgangaagangccacagagnnctagtctccctanctctacacccgcaaganaaanatggcatctcacatacgttggatacccccgtatgggttcccaagagagnntncaanttcgctctcgagtcnttctgggatngcaanancagcgccgangctttgcaganggtgtcntctgatctcagggcanccatctggnancagttggctgatgntgggntcaagtacatccccngca

SEQ ID NO: 2671 - DNA, 303 bp, Glycine max
  unsure (1)..(303): unsure at all n locations
nttgcgtncacgcgtacgnnagctcggaattcggctcgcagtgcacgtgtnattangnnaaatgagaaanaaaaaaatggtcatcncacatcgnnggatacncccgtatgggtgcccaagagagagcncaagntcgcttctcgagtcttncngggatggcaagagcagcgcngaggatttcncagaaggtgtcttcnganctcagggcatccancnggaagcagatggctgttgctgggatcaagtanancccnancaanacttcngcncactatgatcaggntcacnacgcnctgccacnct

SEQ ID NO: 2672 - DNA, 284 bp, Glycine max
  unsure (1)..(284): unsure at all n locations
agngacgcgtactaagtcggaattcggctcgagaagataagcttgttgtgtccacctcctcctcccttcttcacactgctgtngancccagttaacgagaccaagttggatgatgagatcaagtcatgggctagcttttgnctggcccaanaaaattgtnngaagttaaacggcattgggctaaaaggcattggtgctgggaccancaagggatggagggcctttctttctctgggtaaatggctggctggctactgggctttccaagggaaagttctttcctn

SEQ ID NO: 2673 - DNA, 296 bp, Glycine max
  unsure (1)..(296): unsure at all n locations
cntgcncgtanntnagctcggaattcggctcgagctgaggttgttgttgttgccaaggntgtaaatnatggtcccgcttctgtgcgtgatggctnctnaanccaatgccaaatccatgcaggngcntgccacgtcgaancgtaccantaacaaggcggttaaggaccgtcaagccagcgtcactcctgagcaacacgngcgcaagtctcagttccctgaacgttatgcccagcagaagaagcacttgagcctccttgttccccaccaccaccattggttccttccctcagaccana

SEQ ID NO: 2674 - DNA, 269 bp, Glycine max
  unsure (1)..(269): unsure at all n locations
gcgcntgcantnanacgtngagntcggaattcggctcgagcttccaatccttccaaccaccactattggnncnttcngtcagantnnannantgaggagggtacgccgtgagttcaangctaanaagntctnnnnnggaantntatgnctaagtcaattaaggnggaaattcgcaaagttgttgaacttcaagaagagcttgatattgatgttcttgttcatggaganccagagngaaatgntatggttgagtacttcggtgagcaatt

SEQ ID NO: 2675 - DNA, 216 bp, Glycine max
  unsure (1)..(216): unsure at all n locations
nngtcganacntgcgtacgtaancncggaattcggctcgagggcaagaccagcgccgnngattngcagnnggtgtctnctaancncaggagcatccatcnggaagcagatggcngatgctgggatcaantacatccccagcaacactttgctactcacnanaaccaggtnctcgacgccnccgccaccctacggngccgntgccacnnaggtangg

SEQ ID NO: 2676 - DNA, 263 bp, Glycine max
  unsure (1)..(263): unsure at all n locations
anatgaccagaagacggtcattggctttgggcggctctggctcagagctttaccaagcgcccaatgaagggaatgcttaccggaccagttgagaatggtaacaggaccggtaagcattctcaactggtcctttgttagaaatgaccaacctagatctgagaccacctaccagattgctttgtctatcaaggacgaagtggaagaccttgaaaaggctggcatcactgttatccaaattgatgaagctgctttgagagagggtc

SEQ ID NO: 2677 - DNA, 291 bp, Glycine max
  unsure (1)..(291): unsure at all n locations
cgcangcacgcgtacgtaagctcggaattcggctcgagtngggngcgggnggcgtgaagccaccgatcatnnatggtgatgtgagccgcccaaagccaatganngtcttctngngatnnctggntcagagctttacnaagcgcccaatgaagggaatgcttaccggtcctgttaccannctcaactgggnnnntgttagaaatgaccancctagatctgagaccacctagnagantgctttgtctatcaaggacgaatggaaganncnnnccaaggctggcatcantgtna

SEQ ID NO: 2678 - DNA, 267 bp, Glycine max
  unsure (1)..(267): unsure at all n locations
cctanggtgccgntccacnanggnacngntgncnccggcggngagattnggtttgatacctacttctccatggccanangtaatgctaccgtgccagctatggagatgaccaagtggttcgacaccaactaccactntattgtccctgaattgggccctgatgtgaacttcacctatgcttctcacaaggctgttgatgaatacaaggaggccaaggcgcttgnagtggataccgttccggtcctcgttggccctgttacatacctg

SEQ ID NO: 2679 - DNA, 252 bp, Glycine max
  unsure (1)..(252): unsure at all n locations
cagaagccncagaagaagccacagagaactagtctnctactcnccaccngcaagnaccnnnatggcatnntcncctcgttggatacccccgtatgggtccncaannngagagctcaagttgtctcgagtctttctgggatggcaagagnnagcgccgagggatttgcagaaggtgtcttctgatctccagggcatccatctggaagcagatggtgatgctgggatcaagtacatccccagcaaactttctnt

SEQ ID NO: 2680 - DNA, 324 bp, Glycine max
  unsure (1)..(324): unsure at all n locations
gtcgcangcacgcgtacgtnagctcggnattcggctcgagcacgagaccaagttggatgatgagatcaagtcatggctagcttttgctgcccaanaaattgttgaagttaacgcattggctaaagcattgtctggccacaaggatgaggccttcttctctggtaatgctgctgctctggcttcaaggaagtcttctccaaagagttgaccaaacgagggctgntccagaaagnctgctgctagcaattgaagggttccagatcatngccggncaacaattntccatgccagactggatnctcaacaaaagaagnncaaccttcc

SEQ ID NO: 2681 - DNA, 362 bp, Glycine max
  unsure (1)..(362): unsure at all n locations
tnnaggtagtagctcggattcggtcgagctctccatggccagaggtaatgctaccgtgcctgctatggagatgaccaagtggtncgacacnaactaccactttattgtgcccngnattgggccctggatgnagaactttcacctatgnctntcttcacaagggctgtntggatgcagatancaagggaaggtccaagggtcgatttggggagtcgggatanccaatntccncggnaactccgtntggggccnctggtttaancatnactttggtataggctacctnnccaaaggtcctgggcacaaanggggcaaatttcgganggtaaaattcccattggggggcttcctgcccttgcttc

SEQ ID NO: 2682 - DNA, 321 bp, Glycine max
  unsure (1)..(321): unsure at all n locations
cgtcgnangcncgcgtncgtcagctcggnnttcggctcgngctgnacctgtgcttgtgggacctgtttcttncttgttgctgtcannaccagctaagggtgttgagangtcattttcccttctttccctaattgacaagatccttcctgtctacagggaagttgtggctgaactgaaggcagctggtgctacttggatccagtttgatgaacctacccttgtgaaggatctcaatgcccaccagttacaagcatttacccatgcctacgcagagttagagtcaagtttntctggtttgnntgttctgattganacatactt

SEQ ID NO: 2683 - DNA, 315 bp, Glycine max
  unsure (1)..(315): unsure at all n locations
gnngcacgcgtacgtaagctcggaattcngctcgagctgncntcaacttgntccctcagaagcgnntannaatccacanagaactatgtctcnctactncncacccgcaagaaaaaaatggcntntcaacatcgttggatacccccgtatnggncccaatagaganctnaattcgctctcgagtctatctgggatgncaanagtacgccgaggatttgcanaangngtctactgatctcagggcatccntctgganncagatggntnatgctgggatcagtacatccncagcaacatttctctnactntgaccan

SEQ ID NO: 2684 - DNA, 174 bp, Glycine max
  unsure (1)..(174): unsure at all n locations
gctgcaggcacgcgtacgtnagctcggaattcggctccgngcttcancttgctccctcagaagcgnagaagaagcccanagagaanagnctcctantctcacccgcaagnnnaanatggnatctcacatcgttggntacncccgtatgggtcccaagagagagctnaagttgnt

SEQ ID NO: 2685 - DNA, 303 bp, Glycine max
  unsure (1)..(303): unsure at all n locations
aacngaaagncgcangcacgcgtacgtaagctcggaattcggctcgagcttcaggatctccgaggaagagtatgtaaagtcaattaaggaggaaattcgcaaagttgttgagcttcaagaagagcttgatattgatgttcttgttcatggagaaccagaggtccgctctcatttcataacatgactaaatattagtcttttgaattgaagatagcttctttctttctgaagagcaactactctttgcatattttctttcctattgttagattgcngattccaaaattgcagcacctccaactn

SEQ ID NO: 2686 - DNA, 103 bp, Glycine max
  unsure (1)..(103): unsure at all n locations
gntttntttnttttttgggttgttttcnnttggttttttttgtttttnntgnttnttggttntttgtttttttttgtttnttntgttttnttttttttttnnt

SEQ ID NO: 2687 - DNA, 523 bp, Glycine max
  unsure (1)..(523): unsure at all n locations
gnnngnaggttttganngggggggagggnnnnnnnnnnnnnnnnnnnnnnnnnnnnnnnnnnnnnnnnnnnnnnnnnnnnnnnnnnnnnnnnngnttgntnccttanaagcnaagaagaanccncananaancnggcttctaattttttttaaccaccagaaaaatggnnttttaaantcggtnggntnccccggattgggnccaaggagagagctaaagttcgttctcgagtctttctgggatggcaaggagcagcgccgaggatttgcagaaaggtggctgcttgatctcaaggtcatccatctggnaagcagatggctggtggctgggatcaaagtaccttccccagcaacacttttctcgttctatgaccaagcttgntcgacgccaccgncaccctcggtgccgtcccccccaggtacggntggaccggcggcgagattggattcgacacctacttctccatggncagaggtaatgctaccgtgcctgctatggagatgaccaatggttcgacaccaa

SEQ ID NO: 2688 - DNA, 570 bp, Glycine max
  unsure (1)..(570): unsure at all n locations
agaggcctgcttgnctttatcanananannncacngccatgccctccgaacttccatttcngcccaggcgtactcccacgcntcctcagtngnccaacgaggctgttcanaangctgctgctgcattgaangnttngganggtntccntgcaacaaatgtcaggtgccanactggattctcaacaaaagaanctcaaccttncaatnctgncaaccaccactattggatccttccctcagactgtataactgaggagggtacgcccctgaattnaaagctaacaagatctccgangaanangtatgtnnatgtcantttaaggaggaaattttcaaantttgtttgagcttnnataaaagcttnatattnatnttcttgtcatnnagaannncagatgaaatgntatggttcnagtnccttttngggacaaattttctaanctttttccntttacncnnntatnnggtnngttncaaatcttttgggtccccctttcntnnaaanccnnnatcatnttttngntganttttatncncccaaantnaannannccgctttnttttnttttt

SEQ ID NO: 2689 - DNA, 566 bp, Glycine max
  unsure (1)..(566): unsure at all n locations
agaggttnnnttttttnnatnnaaagtattttnnnnnnnnnnnnnnnnnnnnnnnnnnnnnnnnnnnnnnnnnnnnnnnnnnnnnnnnnnnnnnnnnnnnnnnngttaggnaaatgaccaaccttagatctnngaccacctaccngggtgctttggctatnaagggccnaantggagggaccttgaaaaggctggcatcactgttatccaaattgatgaaactgctttgagagaaagggtctgccactgagggaaatcaagaacaaggctcacttacttggactgggctngtncatgcctttnagnaatcaccaatgttggnntnntccnngataccactcaaaattcacacccacatgtgctanctccaaacttttaacgacattnttcaatccatnaatttnacatgggcccttattgttattcaccatttgaanaactnttgcttccgaattaanaaacttccntgtnaaagtcntttcntggaaaaggtgttaaaanattgggtcttgggaaattnggnccttggnngtttatttaaaatnccanttccccaanaaatnccc

SEQ ID NO: 2690 - DNA, 300 bp, Glycine max
  unsure (1)..(300): unsure at all n locations
tcgcatgcacgcgtacgtaagctcggaattcggctcgagcaaagacccttgatttgataaagcaaggntttccatctggaaaatttctttttgctggtgttgttgatggaagattnatttgggccaataattttgcatcttctctgaacacccttcaggcacttggagacattgttggaaatgacaaggttgtggtttccacgtcgtgttctcttcttcacactgcagttgatctggtgaatgagaccaaattggaccaagagattaagtcttggcttgcatttgcagcacaaaaagttg

SEQ ID NO: 2691 - DNA, 239 bp, Glycine max
  unsure (1)..(239): unsure at all n locations
ngtcgcangcacgcgtacgtnagctcggaattcggctcgagcttgatttnatcaagcaaggatttccatctggaaaatttctntncgctggtgttgttgatgngaaganatatttgggccaatagtcttgcatcttctctgaacacccttcaggcacttggggacattgttgggaatgacaaggttgtggtttccacgtcctgttctcttcttcacactgcagttgatctgtgaatgag

SEQ ID NO: 2692 - DNA, 303 bp, Glycine max
  unsure (1)..(303): unsure at all n locations
tcgcatgcacgcntaagtnagctcggaattcggctcgagcatttactgccaatgggtgggtgcaatcatatggatcccgctgtgtcaaacctcccatcatctatggtgatgtgagccgtcccaagcccatgacagttttctggtcttcaactgctcaaagtttgaccaaacgaccaatgaagggaatgcttactggccctgttactattctgaactggtcctttgttagagatgaccaaccaagatttgaaacatgttaccagattgctttggctatcaaggatgaggttgaggatcttgaga

SEQ ID NO: 2693 - DNA, 306 bp, Glycine max
  unsure (1)..(306): unsure at all n locations
gtcgcacgcacgcgtacgtnagctcggaattcggctcgagctgtgtcaagcctcccatcatctatggtgatgtgagccgtcccaancccatgactgtttnctggtcttncaactgctcaaagtttgaccaaacgaccaatgaagggaatncttactggccctgttactattctgaactggtcctttgttagagatgaccagccaagattcgaaacatgctaccagattgctttggctatcaaggatgaggttgaggatcttgagaaagcaggtattactgtcatccagattgatgaagctgctctt

SEQ ID NO: 2694 - DNA, 459 bp, Glycine max
ccacgcgtccggtgttctcttcttcacactgcagttgatctggtgaatgagaccaaattggaccaagagattaagtcttggcttgcatttgcagcacaaaaagttgttgaagtaaatgccttggccaaggcattgtctggacagaaggatgaggttttcttttctgctaatgctgctgccttggcttcaaggaagtcctccccaagggtgataaatgaggctgtccaaaaagccgctgctgctctgaagggctctgatcatcggagggccacaaatgttagtgccaggttggatgctcaacagaagaaattgaatctttctgttcttccaacaactacaattggatctttccctcaaactgccgatcttagaagagttcgtcgtgaattcaaggctaacaagatctccgaggaagattatatcccgtttcattaaggaggaaatttacaatgttgtaaa

SEQ ID NO: 2695 - DNA, 306 bp, Glycine max
  unsure (1)..(306): unsure at all n locations
gcncgnacgcgtacgtaagctcggaattcggctcgagggttttcttttctgctaatgctgctgccttggcttcaaggaagtcctccccaagggtgataaatgaggctgtccaaaaagccgctgctgctctgaagggctctgatcatcggagggccacaaatgttagtgccaggttggatgctcaacagaagaaattgaatctttctgttcttccaacaactacaattggntctttccctcaaactgccgatcttagaagagttcgtcgtgaattcaaggctaacaagatctccgaggaagattata

SEQ ID NO: 2696 - DNA, 285 bp, Glycine max
  unsure (1)..(285): unsure at all n locations
acgtcgcatgcacgcgtacgtaagctcggaattcggctcgaggtaaatgccttggccaaggcattgtctggacagaaggatgaggttttcttttctgctaatgctgctgccttggcttcaaggaagtcctccccaagggtgataaatgaggctgtccaaaaagccgctgctgctctgaagggctctgatcatcggagggccacaaatgttagtgccaggttggatgctcaacagaagaaattgaatctttctgttcttccaacaactacaattnggtctttccct

SEQ ID NO: 2697 - DNA, 303 bp, Glycine max
  unsure (1)..(303): unsure at all n locations
acgtcgcangcacgcgtacgtaagctcggaattcggctcgagngaagctgtccaaaaggccgctgctgctctgaagggctctgatcatcggagggccacaaatgttagtgccaggctggattctcaacagaagaaactgaatcttcctgttcttccaacaactacaattgngctctttccctcaaactgccgatcttagaagagttcgccgtgaattcaaggctaacaagatctccgaggaanntatatccatttcattaaggagggaaattaacaatgttgtgaagctccaggaagaattga

SEQ ID NO: 2698 - DNA, 260 bp, Glycine max
  unsure (1)..(260): unsure at all n locations
gtcgcntgcacgcgtacgtaagctcggaattcggctcgagtggtgaatganaccaaattggaccaagagattaagtcttggcttgcatttgcagcacaaaaagttgttgaagtaaatgcctggccaaggcattgtctggaagaaggatgaggttttcttttctgctaatgctgctgccttggcttcaaggaagtcctccccaagggtgataaatgaggctgtccaaaaagccgctgctgctctgaagggctctgatcatc

SEQ ID NO: 2699 - DNA, 193 bp, Glycine max
  unsure (1)..(193): unsure at all n locations
taacnagacgtcgcangcacgcgtacgtaagctcggaattcggctcgagntgataaatgaggctgtccaaaaagccgctgctgctctgaagggctctgatcatcggagggccacaaatgttagtgccaggttggatgctcaacagaagaaattgaatctttctgttcttccaacaactacaattggatctttc

SEQ ID NO: 2700 - DNA, 307 bp, Glycine max
  unsure (1)..(307): unsure at all n locations
gtcgcangcacgcgtacgtaagctcggaattcggctcgagnctggtattactgtcatccagattgatgaggctgctctaagagaaggtttacctctgaggaagtctgaggaggctttctatctaaactgggctgttcactcatttaggattaccaactgtggtgtggaggacactactcagattcacactcacatgtgctactccaacttcaatgacatcattcactcantcntagacatggatgctgatgtgatcaccattgagaactccagatcagatgagaagttactttcggtcttccgtgng

SEQ ID NO: 2701 - DNA, 361 bp, Glycine max
gtcgcatgcagcgtacgtaagctcggaattcggctcgaggattcgaaacatgctaccagattgctttgggctatcaaggatgaggttgaggatcttgagaaagcaggtattactgtcatccagattgatgaagctgctctaagagaaggtttacctctgaggaagtctgaggaggctttctatctaaactgggctgttcactcatttaggattaccaactgtggtgtggaggacactactcagattcacactcacatgtgctactccaacttcaatgacatcatcactcaatcatagacatggatgctgatgtgatcaccatgagaactctagatcagacgagaagttactttcagtcttc

SEQ ID NO: 2702 - DNA, 293 bp, Glycine max
gtcgcatgcacgcgtacgtaagctcggaattcggctcgaggctgctctaagagaaggtttacctctgaggaagtctgaggaggctttctatctaaactgggctgttcactcatttaggattaccaactgtggtgtggaggacactactcagattcacactcacatgtgctactccaacttcaatgacatcattcactcaatcatagacatggatgctgatgtgatcaccattgagaactctagatcagacgagaagttactttcagtcttccgcgagggagtgaaatatggtg

SEQ ID NO: 2703 - DNA, 282 bp, Glycine max
  unsure (1)..(282): unsure at all n locations
gtcgcangcacgcgtacgtaagctcggaattcggctcgagattactgtcatccagattgatgaagctgctctaagagaaggtttacctctgaggaagtctgaggaggctttctatctaaactgggctgttcactcatttaggattaccaactgtggtgtggaggacactactcagattcacactcacatgtgctactccaacttcaatgacatcattcactcaatcatagacatggatgctgatgtgatcaccattgagaactctagatcagacgagaagtt

SEQ ID NO: 2704 - DNA, 272 bp, Glycine max
  unsure (1)..(272): unsure at all n locations
cgtcgcangcncgcgtacgtnagctcggaattcggctcgaggagatgaccaaccaagatttgaaacatgttaccagattgctttggctatcaaggatgaggttgnggatcttgagaaagctggtattactgtcatccagattgatgaggctgcnctaagagaaggtttacctctgaggaagtctgaggaggctttctatctaaactgggctgttcactcatttaggattaccaactgtggtgtggaggacactactcagatncacactcaca

SEQ ID NO: 2705 - DNA, 298 bp, Glycine max
gtcgcatgcacgcgtacgtaagctcggaattcggctcgagaagaagttcaaccttccaatcctcccaaccaccacaattggatccttccctcagactgttgaactgaggagggtgcgtcgtgaatacaaggctaacaagatctcagaggaggagtatgttagttcaattaaagaggaaatccgcaaagttgttgaactccaagagaatcttgatatcgatgtcctggtacacggggagcctgagaggaatgacatggtggagtactttggtgagcagttgtcaggctttgcctttacc

SEQ ID NO: 2706 - DNA, 307 bp, Glycine max
  unsure (1)..(307): unsure at all n locations
nncgcatgcacgcgtacgtaagctcggaattcggctcgagaagaagttcaaccttccaatcctcccaaccaccacaattggatccttccctcagactgttgaactgaggagggtgcgtcgtgaatacaaggctaacaagatctcagaggaggagtatgttagttcaattaaagaggaaatccgcaaagttgttgaactccaagagaatctgcatatcgatgtcctggtacacggngagcctgagaggaatgacatggtggagtactttggtgagcagttgtcaggctttgcctttaccgttaaggct

SEQ ID NO: 2707 - DNA, 452 bp, Glycine max
  unsure (1)..(452): unsure at all n locations
ccacgcgtccgctggaagcagatggctgatgctggaataaagtatattcctagcaacaccttctcactttacgatcaagtactggacacaacagccatgctcggggcagttccatctagatataattggaatggtggggagattgggtttgatgtttacttctcaatggcaagagggaatgcatctgtaccagctatggaaatgaccaagtggtttgacaccaattaccattacattgttcctgaattgggtcctgatgttaagttctcctatgcatcacacaaggctgtcgatgaatttaaagaggccaaagttctgggagttaatactgtacctgtgcttgtgggacctgtatcctacttgttgctgtcaaaaccagctaagggtgttgaagaagtcattttcccttctttccctaattgacaagatccttcctgtctacagggangttt

SEQ ID NO: 2708 - DNA, 260 bp, Glycine max
  unsure (1)..(260): unsure at all n locations
acgtcgcangcacgcgtacgtaagctcggaattcggctcgagcaagtggtttgacaccaattnccattacattgttcctgaattgggtcctgatgttaagttctcctatgcatcacacaaggctgtcgatgaatttaaagaggccaaagttctgggagttaatactgtacctgtgcttgtgggacctgtatcctacttgttgctgtcaaaaccagctaagggtgttgagaagtcattttcccttctttccctaattgaca

SEQ ID NO: 2709 - DNA, 275 bp, Glycine max
  unsure (1)..(275): unsure at all n locations
atcgcatgcacgcgtacgtaagctcggaattcggctcgagcaacagccatgcttggggcagttccatctagatataattggaatggtggggagattgggtttgatgtttacttctcgatggcaagagggaattcatctgtaccagctatggaaatgaccaagtggtttgacacaaactatcattacattgttcctgaattgggtccagatgttaagttctcctatnccatcacacaaggttgtggatgaatacntngaggctaaagttctgggaa

SEQ ID NO: 2710 - DNA, 304 bp, Glycine max
  unsure (1)..(304): unsure at all n locations
ntnacgcntacgtaagctcggaattcggctcgagctagtctcctactctcacccgcaagaaaaaaaatggcatctcacatcgttggatacccccgtatgggtcccaaganagagctcaagttcgctctcgagtctttctgggatggcaagagcagcgccgaggatttgcagaaggtgtcttctgatctcagggcatccatctggaagcagatggctgatgctgggatcaagtacatccccagcaacactttctctcactatgaccaggttctcgacgccaccgccaccctcggtgccgttccac

SEQ ID NO: 2711 - DNA, 341 bp, Glycine max
  unsure (1)..(341): unsure at all n locations
tcgcangcacgcgtacgtaagctcggaattcggctcgagctccactcagaagcgaagaanaagccacagagaactagtctcctacttctcacccgcaaganaaaaatggcatctcacatcgttggatacccccgtatgggtcccaagagagagctcaagttcgctctcgagtctttctgggatggcaagancagcgccgaggatttgcagaaggtgtcttctgatctcagggcatccatctggaagcagatggctgatgctgggatcaagtacatccccagcaacactttctctcactatgaccaggttctcgacgccaccgccaccctcggtgccgttcc

SEQ ID NO: 2712 - DNA, 322 bp, Glycine max
  unsure (1)..(322): unsure at all n locations
gtcgcnngcacgcgtacgtaagctcgcgaattcggctcgaggcgaagaagaagccacagagaaccagtctcctactctctctcacccacaagaaaaatggcatctcacatcgttggatacccccgcatgggtcccaagagagagctcaagttcgctctcgagtctttctgggatggcaagagcagcgccgaggatttgcagaaggtggctgctgatctcaggtcatccatctggaagcagatggctggtgctgggatcaagtacatccccagcaacactttctcgttctatgaccagctgctcgacgccaccgccaccctcg

SEQ ID NO: 2713 - DNA, 328 bp, Glycine max
  unsure (1)..(328): unsure at all n locations
ttgctccctcagaagcgacacngaagccacagagcactagtctcctactctcacccancaaganaaaaatggcatctcacatcgttggatacccccgtatgggtcccaagagagagctcaagttcgctctcgagtctttctgggatggcaagagcagcgccgaggatttcagaaggtgtcttctgatctcagggcatccatctggaagcagatggctgatgctgggatcaagtacatccccagcaacactttctctcactatgacanggttctcgacgccaccggcaccctcggtgccgttncaccaagtaggtggancggcggcgag

SEQ ID NO: 2714 - DNA, 339 bp, Glycine max
  unsure (1)..(339): unsure at all n locations
angcacgcgtacgtaagctcggaattcggctcgagctctgcttcaacttgctccctcagaagcgaagaagaagccacagagaaccagtctcctactctctctcacccacaagaaaaatggcatctcacatcgttggatacccccgcatgggtcccaagagagagctcaagttcgctctcgagtctttctgggatggcaagagcagcgccgaggatttgcagaaggtggctgctgatctcaggtcatccatctggaagcagatggctggtgctgggatcaagtacatccccagcaacactttctcgttctatgaccagctgctcgacgccaccgccaccc

SEQ ID NO: 2715 - DNA, 296 bp, Glycine max
catgcacgcgtacgtaagctcggaattcggctccgagcacagagaaccagtctcctactctctctcacccacaagaaaaatggcatctcacatcgttggatacccccgcatgggtcccaagagagagctcaagttcgctctcgagtctttctgggatggcaagagcagcgccgaggatttgcagaaggtggctgctgatctcaggtcatccatctggaagcagatggctggtgctgggatcaagtacatccccagcaacactttctcgttctatgaccagctgctcgacgccaccg

SEQ ID NO: 2716 - DNA, 308 bp, Glycine max
  unsure (1)..(308): unsure at all n locations
ngtngcangcacgcgtacgtaagctcggaattcggctcgagtttgcagaaggtgtcttctgatctcagggcatccatctggaagcagatggctgatgctgggatcaagtacatccccagcaacactttctctcactatgaccaggttctcgacgccaccgccaccctcggtgccgtccaccaaggtacggctggcaccggcggcgagattgggtttgatacctacttcnccatggccagaggtaatgctaccgtgccagctatggagatgaccaagtggttcgacaccaactaccacnctnttgtccc

SEQ ID NO: 2717 - DNA, 314 bp, Glycine max
  unsure (1)..(314): unsure at all n locations
annttnncgtacgtaanctcggaattcggctcgagcttgctccctcananncntgaanaagccacagagaactagtctcctaactctcacccgcaagacnaaaaatggcatctcacatcgttggntacccccgtatnggtcccaagagagagcncaagttcgctctcgagtctttctgggatggcaagagcagcgccgaggatttgcagaaggtgtcttctgatctcagggcatccatctggaagcagatggctgatgctgggatcaagtacatccccagcaacactttctctcactatgaccaggttctcgac

SEQ ID NO: 2718 - DNA, 307 bp, Glycine max
  unsure (1)..(307): unsure at all n locations
gtcgcangcacgcgtacgtaagctcggaattcggctcgagctccctcagaagcgaagaagaagccacagagaaccagtctcctactctctctcacccacaagaaaaatggcatctcacatcgttggatacccccgcatgggtcccaaganagagctcaagttcgctctcgagtctttctgggatggcaagagcagcgccgaggatttgcagaaggtggctgctgatctcaggtcatccatctggaagcagatggctggtgctgggatcaagtacatccccagcaacactttctcgttctatgaccag

SEQ ID NO: 2719 - DNA, 318 bp, Glycine max
acgcgtacgtaagctcggaattcggctcgaggcttcaacttgctccctcagaagcgaagaagaagccacagagaaccagtctcctactctctctcacccacaagaaaaatggcatctcacatcgttggatacccccgcatgggtcccaagagagagctcaagttcgctctcgagtctttctgggatggcaagagcagcgccgaggatttgcagaaggtggctgctgatctcaggtcatccatctggaagcagatggctggtgctgggatcaagtacatccccagcaacactttctcgttctatgaccactgctcgacg

SEQ ID NO: 2720 - DNA, 324 bp, Glycine max
  unsure (1)..(324): unsure at all n locations
gcacgcgtacgtaagctcggaattcggctcgagctcagaancgaanaagaagccacncnagaactagtctcctactctcacccgcaanaaaaaaatggcatctcacatcgttcngatacccccgtatgggtcccaagagagagctcaagttcgctctcgagtctttctgggatggcaagagcagcgccgaggatttgcagaaggtgtcttctgatctcagggcatccatctggaagcagatggctgatgctgggatcaagtacatccccagcaacactttctctcactatgaccaggttctcgacgccaccgncaccctcggtn

SEQ ID NO: 2721 - DNA, 331 bp, Glycine max
  unsure (1)..(331): unsure at all n locations
nncncnngcatncgtacgtaagctcggaattcggctcgagcggctcgagttcaacttgctccctcagaagcgaagaagaagccacagagaactagtctcctactctcacccgcaagaaaaaaatggcatctcacatcgttggatacccccgtatgggtcccaagagagagctcaagttcgctctcgagtctttctgggatggcaagagcagcgccgaggatttgcagnaggtgtcttctgatctcagggcatccatctggaagcagatggctgatgctgggatcaagtacatccccagcaacactttctctcactatgaccaggttctcgn

SEQ ID NO: 2722 - DNA, 327 bp, Glycine max
  unsure (1)..(327): unsure at all n locations
gttgcangcacgcgtacgtaagctcngaattcggctcgaggccacagagactccagtctcctactctctctcacccanaagananntggnatntcacntcgttggatacccccgcatgggtcccaaganagagctcnagttcgctctcgagtctttctgggatggcnagnncngcgccgaggatttggcanaaggtggctgctgatctcaggtcatccatctcgaagcagatggctggtgctgggatcaagtacntccccagcaacactttctcgttctatgaccagctgctcgacgccaccgccaccctcggtgccgtccccccag

SEQ ID NO: 2723 - DNA, 316 bp, Glycine max
  unsure (1)..(316): unsure at all n locations
gtcgcatgcacgcgtacgtaagctcggaattcggctcgagggctgatgctgggatcaagtacatccccagcaacactttctctcactangaccnggtttctcgacgccaccgcnaccctcggtgccgttccaccaaggnacggctggaccggcggcgagattgggtttgatacctacttctccatggccanangtaatgctaccgtgccagctatggagatgaccaagtggttcganaccaactancactttattgtccctgaatgggcnctgatgtgaacttcacctatgcttctcacaaggcngctgatgaana

SEQ ID NO: 2724 - DNA, 320 bp, Glycine max
  unsure (1)..(320): unsure at all n locations
cgntnnnaagcgtacgtnagctcggaattcggctcgagcttgctccctcagaagcgaagaagaagccacagagaaccagtctcctactctctctcacccacaagaaaaatggcatctcacatcgttggatacccccgcatgggtcccaagagagagctcaagttcgctctcgagtcttctgggatggcaagagcagcgccgaggatttgcagaaggtggctgctgatctcaggtcatccatctggaagcagatggctggtgctgggatcaagtacatccccagcaacactttctcgttctatgaccagctgctcgacgcc

SEQ ID NO: 2725 - DNA, 301 bp, Glycine max
  unsure (1)..(301): unsure at all n locations
gtcgcangcacgcgtacgtaagctcggaattcggctcgagctcagaagcgaagaagaagccacagagaactagtctcctactctcacccgcaagaaaaaaatggcatctcacatcgttggatacccccgtatgggtcccaagagagagctcaagttcgctctcgagtctttctgggatggcaagagcagcgccgaggatttgcagaaggtgtcttctgatctcagggcatccatctggaagcagatggctgatgctgggatcaagtacatccccagcaacactttctctcactatgaccag

SEQ ID NO: 2726 - DNA, 312 bp, Glycine max
  unsure (1)..(312): unsure at all n locations
gtngcatgcncgcgtacgtaagctcggnattcggctcganctcgagccgaatcggctcgagagaaaaatggcatctcacatcgttagatacccccgcatgggncccaagagagagctcaagttcgctctcgagtctttctgggatggcaagagcagcgccgaggatttgcagaaggtggctgctgatctcaggtcatccatctggaagcagatggctggtgctgggatcaagtacatccccagcaacactttctcgttctatgaccagctgctncgacgccaccgccaccctcggtgccgtcccccccangt

SEQ ID NO: 2727 - DNA, 301 bp, Glycine max
  unsure (1)..(301): unsure at all n locations
nncgtctcangcacgcgtacgtnagctcnnnaattcggctcgaggaactagtctcctactctcanccncaananaataatggcatctgcacatgcgntggatacccccgtatgggtcccaagagnnanctcaagttcgctctcgagtctttctgggatggcaagagcaccgccgaggatttgcagaaggtgtcttctgatctcagggcatccatctggaagcagatngctgatgctgggatcaagtacatccccancaacactttctctcactatgaccaggtnctcgacgccnccgccat

SEQ ID NO: 2728 - DNA, 316 bp, Glycine max
  unsure (1)..(316): unsure at all n locations
angtcgcangcacgcgtacgtaagctcggaattcggctcgagtgcttcaacttgctccctcagaagcgaagaagaagccacagagaaccagtctcctactctctctcacccacaagaaaaatggcatctcacatcgttggatacccccgcatgggtcccaagagagagctcaagttcgctctcgagtctttctgggatggcaagagcagcgccgaggatttgcagaaggtggctgctgatctcaggtcatccatctggaagcagatggctggtgctgggatcaagtacatccccagcaacactttctcgttctatg

SEQ ID NO: 2729 - DNA, 330 bp, Glycine max
  unsure (1)..(330): unsure at all n locations
natctcangcaagcgtacgtattctcgnnattnggcnacgaggcttcaacttgctccctcagaancgaagaagaagnnacagananctantctcctactctcacccgcaagaanaaaatngcatctcacatcgttggatacccccgtatgggtcccaagagagagctcaagttcgctctcgagtctttctgggatggcaagagcagcgcngaggatttgcagaaggtgtcttctgatctcagggcatccatctggaagcagatggctgatgctgggatcaagtacatccccagcaacactttctctcatatgcaccaggttctcgaagcc

SEQ ID NO: 2730 - DNA, 271 bp, Glycine max
  unsure (1)..(271): unsure at all n locations
cccgtatgggtcccaagagagagctcaagttcgctctcgagtctttctgggatggcaagagcagcgccgaggatttgcagaaggtgtcttctgatctcagggcatccatctggaagcagaggctgatgctgggatcaagtacatccccagcaacactttctctcactatgaccaggttctngacgcnaccgncannctcggtgntgtnccatnaaggnangnntatannggttgtnatnnnggntnnannnttntttccangttntgcagg

SEQ ID NO: 2731 - DNA, 318 bp, Glycine max
  unsure (1)..(318): unsure at all n locations
tcccgtacgtnagctcggaattcggctcgnggcttcancttgctccctcagaagcgaagaagaagccacagagaactagtctcctactcncanccncnaganaaaaatggcatctcacatcgttggatacccccgtatgcgtcccaaganagagctcaagttcgctctcgagtctttctgggatgcaagagcagcgccgaggatttgcagaaggtgtcttctgatctcagggcatccatctggaagcagatggctgatgctgggatcaagtacatccccagcaacactttctctcactatgaccaggttctcgacgca

SEQ ID NO: 2732 - DNA, 307 bp, Glycine max
  unsure (1)..(307): unsure at all n locations
acangcatgcacgngtacgtaagctcggaattcggctcgagctctgcttcaacttgctccctcagaagcgaagaagaagccacagagaactagtctcctacttcttcacccgcaaganaaaaatggcatctcacatcgttggatacccccgtatgggtcccaaganagagctcaacttcgctctcgagtctttctgggatggcaagagcagcgccgaggatttgcagaaggtgtcttctgatctcagggcatccatctggaagcagatggctgatgctgggatcaagtacatccccagcaacacttt

SEQ ID NO: 2733 - DNA, 304 bp, Glycine max
  unsure (1)..(304): unsure at all n locations
ncgtcgcatgcacgcgtacgtnagctcggaattcggctcgagcttcaacttgctccctcagaagcgaagaagaagccacagagaaccagtctcctactactactctcacccacaagaaaaatggcatctcacatcgttggatacccccgcatgggtcccaagagagagctcaagttcgctctcgagtctttctgggatggcaagagcagcgccgaggatttgcagaaggtggctgctgatctcaggtcatccatctggaagcagatggctggtgctgggatcaagtacatccccagcaacactt

SEQ ID NO: 2734 - DNA, 333 bp, Glycine max
  unsure (1)..(333): unsure at all n locations
acacnagnaaatantctgcangcacgcgtacgtaagctcgncaanncggctcgnggcttcaacttgctcnctcagancncgaagangaagccacagagnaccagtctccnnctctntntcacccacaaganaaatgncatctcacatgcntggatanccccgcatgggtcccnaganagagctcaagttcgcnctcgagtctttctgggatggcaagagcagcgccgaggatttgcagaaggtggctgctgatctcaggtcatccatctggaagcagatggctggtgctgggatcaagtacatccccagcaacactttctcgttctatgacca

SEQ ID NO: 2735 - DNA, 299 bp, Glycine max
agtcgcatgcacgcgtacgtaagctcggaattcggctcgagcttgctccctcagaagcgaagaagaagccacagagaactagtctcctactctcacccgcaagaaaaaaatggcatctcacatcgttggatacccccgtatgggtcccaagagagagctcaagttcgctctcgagtctttctgggatggcaagagcagcgccgaggatttgcagaaggtgtcttctgatctcagggcatccatctggaagcagatggctgatgctgggatcaagtacatccccagcaacactttctctc

SEQ ID NO: 2736 - DNA, 333 bp, Glycine max
  unsure (1)..(333): unsure at all n locations
agtcgcangcacgcgtacgtaagctcggaattcggctcgagctcagaagcgaagancnnagccacagagaactagtctgcctactctcacccgcaaganaaaaatggcatctcacatgcgttggatacccccgtatgggtcccaagagagagctcaagttcgctctcgagtctttctgggatggcaagagcagcgccgaggatttgcagaaggtgtcttctgatctcagggcatccatctggaagcagatggctgatgctgggatcaagtacatccccagcaacactttctctcactatgaccaggttcttcgacgcnacgccacctcggtgc

SEQ ID NO: 2737 - DNA, 320 bp, Glycine max
  unsure (1)..(320): unsure at all n locations
agtcgcangcacgcgtacgtaagctcgnanattcggctcgagttgctccctcagcagcnaagaagaagccacagagaactagtactcnctantctcacccgcaagannnaaatggcatctcacatcgntggatacccccgtatgggtcccaagagagagctcnagttcgtnctcgagtctttctgggatggcaagagcagcgccgaggatttgcagaaggtgtcttctgatctcagggcatccatctggaagcagatggctgntgctgggatcaagtacatccccagcaacactttctctnactatggccagttctcnac

SEQ ID NO: 2738 - DNA, 287 bp, Glycine max
  unsure (1)..(287): unsure at all n locations
gtcgcangcacgcgtacgtaagctcggaattcgggctcgagctccctcagaagcgaagaagaagccacagagaaccagtctcctacttctctctcacccacaagaaaaatggcatctcacatcgttggatacccccgcatgggtcccaagagagagctcaagttcgctctcgagtctttctgggatggcaagagcagcgccgaggatttgcagaaggtggctgctgatctcaggtcatccatctggaagcagatggctggtgctgggatcaagtacatccccagcaa

SEQ ID NO: 2739 - DNA, 306 bp, Glycine max
  unsure (1)..(306): unsure at all n locations
gttgcatgtnagcgtacgtaagcttcggaattctggtnnnggatttggatcgagcttnntccctcagnagcgnagaagaagccncagagaactagtctcntactctcacccgcaagaaaaaaatggcatctcacatcgttggatacccccgtatgggtcccaagagagagctcaagttcgctctcgagtctttctgggatggcaagagcagcgccgaggatttgcagaaggtgtcttctgatctcagggcatccatctggaagcagatggctgatgctgggatcaagtacatccccagcaacactt

SEQ ID NO: 2740 - DNA, 291 bp, Glycine max
  unsure (1)..(291): unsure at all n locations
gtcgcangcacgcgtacgtaagctcggaattcggctcgagaacttgctccctcagaagcgaagaagaagccacagagaaccagtctcctactctctctcacccacaagaaaaatggcatctcacatcgttggatacccccgcatgggtcccaagagagagctcaagttcgctctcgagtctttctgggatggcaagagcagcgccgaggatttgcagaaggtggctgctgatctcaggtcatccatctggaagcagatggctggtgctgggatcaagtacatccccagcaa

SEQ ID NO: 2741 - DNA, 322 bp, Glycine max
  unsure (1)..(322): unsure at all n locations
gcacgcgtacgtaagctcggaattcggctcgagatcttgctccctcagaagcgaagaagaagccacagagaactagtctcctactctcacccgcaagaaaaaaatggcatactgcacattcgttggatacccccgtatgggtcccaaganagagctcaagttcgnnctcgagtctttctgggatggcaagcgcagcgccgaggatttgcagaaggtgtcttctgatctcagggcatccatctggaagcagatggctgatgctgggatcaagtacatccccagcaacactttctctcactatgaccagttctcgacgccacgn

SEQ ID NO: 2742 - DNA, 310 bp, Glycine max
  unsure (1)..(310): unsure at all n locations
angcacgcgtacgtnagctcggaattcggctcgagcttgctccctcagaagcgaagnagaagccacagagaactagtctcctactctacacccgcaagaaaaaaatggcatctacacatcgttggatacccccgtatgggtcccaagagagagctcaagttcgctctcgagtctttctgggatggcaagagcagcgccgaggatttgcagaaggtgtcttctgatctcagggcatccatctggaagcagatggctgatgctgggatcaagtacatccccagcaacactttctctcatangaccaggttct

SEQ ID NO: 2743 - DNA, 304 bp, Glycine max
  unsure (1)..(304): unsure at all n locations
agttgcangcacgcgtacntaagctcggaattcggctcgagtcagaagcgaagaagaagccacagagaactagtcnncntactctcacccgcaagaaanaaatngccatctcanatgcgttggatncccccgtatgggtcccaagagagagctcaagttcgctctcgagtctttctgggatggcaagngcancgccgaggatttgcagaaggtgtcttctgatctcagggcatccatctggaagcagatggctgatgctgggatcaagtacatccccagcaacactttctntcactatgaccag

SEQ ID NO: 2744 - DNA, 277 bp, Glycine max
  unsure (1)..(277): unsure at all n locations
tcgcangnacncntcggaattcggctcgagcttgctccctcagaagcgaagaagaagccacagagaaccagtctcctactctctctcacccacaagaaaaatggcatctcacatcgttggatacccccgcatgggtcccaagagagagctcaagttcgctctcgagtctttctgggatggcaagagcagcgccgaggatttgcagaaggtggctgctgatctcaggtcatccatctggaagcagatggctggtgctgggatcaagtacatccccagc

SEQ ID NO: 2745 - DNA, 288 bp, Glycine max
  unsure (1)..(288): unsure at all n locations
gtngcangcacgcgtacgtaagctcggaattcggctcgagctccctcagaagcgaagaagaagccacagagaactagtctcctactctcacccgcaaganaaaaatggcatctcacatcgttggatacccccgtatgggtcccaagagngagctcaagttcgctctcgagtctttctgggatggcaagagcagcgccgaggatttgcagaaggtgtcttctgatctcagggcatccatctggaagcagatggctgatgctgggatcaagtacatccccagcaacactt

SEQ ID NO: 2746 - DNA, 318 bp, Glycine max
  unsure (1)..(318): unsure at all n locations
gttgcangcacgcgtacgtaagctcggaattcggctcgagcagaagcgaagaagaagccanagagaactagtctcctacnnttcacccgcaagaaaaaatggnatctcacatcgttggatacncccgtatgggtnnccaagagagngnnaagttcgntctcgagtctttctgggatggcaagagcagcgccgaggatttgcagaaggtgtcttctgatctcagggcatccatctggacgcagatggctgatgctgggatcaagtacatnnncagcaanactttctctcantatgaccaggttctcgacgcnaccgcca

SEQ ID NO: 2747 - DNA, 331 bp, Glycine max
  unsure (1)..(331): unsure at all n locations
gcaaantcgctgnangcntacgtnagctcgganttcggatngagctcgagccgctgcttcaacttgctacctcagaagcgaagaagaagccacagagaaccagtcncctactctctctcacccacaagaanaatgggatctcacatcgttggatacccccgcatgggtcccaagagagagntcnagttcgctctcgagtctttctgggatggcaagngcngcgccgaggatttgcagaaggtggctgctgatctcaggtcatccatctggaagccagatggctggtgctgggatcaagtacatccccagcaacactttctcgtttatgncc

SEQ ID NO: 2748 - DNA, 307 bp, Glycine max
  unsure (1)..(307): unsure at all n locations
aatcgcangcaagcgtacgtaagctcggaattcggctcgagctctgcttcaacttgctccctcagaagcgaagaagaagccacagagaaccagtctcctactctctctcacccacaagaaaaatggcatctcacatcgttggatacccccgcatgggtcccaagagaagctcaagttcgctctcgagtctttctgggatggcaagagcagcgccgaggatttgcagaaggtggctgctgatctcaggtcatccatctggaagcagatggctggtgctgggatcaagtacatccccagcaacatttct

SEQ ID NO: 2749 - DNA, 302 bp, Glycine max
  unsure (1)..(302): unsure at all n locations
gtcgcangnacgcgtacgtaagctcggaattcggctcgagcttgntccctcagaagcgaagaanaanccacagagaantagtctnctactctgcacccgcaanaaaaaaatggcntctcacatgcgttggatacccccgtatgggtcccaaganagagctcaagttcgctctcgagtctttctgggatggcaagagcagcgccgaggatttgcagaaggtgtcttctgatctcagggcatccatctggaagcagatggctgatgctgggatcaagtacatccccagcaacactttctctcan

SEQ ID NO: 2750 - DNA, 287 bp, Glycine max
  unsure (1)..(287): unsure at all n locations
cangcacgcgtacgtnagctcggaattcggctcgagncttgctccctcagaagcgaagaagaagccacagagaaccagtctcctactctctctcacccacaaganaaatggcatctcacatcgttggatacccccgcatgggtcccaaganagagctcaagttcgctctcgagtncttctgggatggcaagagcagcgccgaggatttgcagaaggtggctnctgatctcaggtcatccatctggnagcagatggctggtgctgggatcaagtacatccccagcaac

SEQ ID NO: 2751 - DNA, 300 bp, Glycine max
  unsure (1)..(300): unsure at all n locations
agtcncangcacgcgtacgtaagctcggaattcggctcgagctggcttcaanttgctccctcagaagcgaagaagaagccacagaganctngtctcctactctcacccgcaaganaaaaatggcatctcacatcgttggatacccccgtatgggtcccaaganagagctcaagttcgctctcgagtctttctgggatggcaagagcagcgccgaggntttgcagaaggtgtcttctgntctcagggcatccatctggaagcagatggctgatgctgggatcaagtacatccccagcaaca

SEQ ID NO: 2752 - DNA, 285 bp, Glycine max
  unsure (1)..(285): unsure at all n locations
ncttncacgcacgcgtacgtnagctcggaattcggctcgggctccctcagaagcgaagaagaagccacagagaaccagtctcctantcnctctcacccacaagaaaaatggcatctcacatcgttggatacccccgcatgggtcccaaganagagctcaagttcgctctcgagtctttctgggatggcaagagnagcgccgaggatttgcagaaggtggctgctgatctcaggtcatccatctggaagcagatggctggtgctgggatcaagtacatcnccagcn

SEQ ID NO: 2753 - DNA, 326 bp, Glycine max
  unsure (1)..(326): unsure at all n locations
tgctgtaanananaangtngcgtgcacgcntacgtaaagctcgggaattcggctcgagctggnttcaanttggntcctcanaagcgaagaagaagccacagagaaccagtctcntantntctntcacccacaagaaaaatggcntctcacatcgttggatacccccgcatgggtcccaaganagagntcaagttcgntntcgagtctttctgggatggcaagancagcgccgaggatttgcagaaggtggctgntgatntcaggtcatccatntggaagcagatggctggtgntgggatcaagtacatccccagcaanactttntc

SEQ ID NO: 2754 - DNA, 281 bp, Glycine max
  unsure (1)..(281): unsure at all n locations
ncgtcgcangcacgcgtacgtaagctcggaattcggctcgaggctccctcagaagcgaagaagaagccacagagaaccagtctcctactctctctcacccacaagaaaaatggcatctcacatcgttggatacccccgcatgggtcccaagagagagctcaagttcgctctcgagtctttctgggatggcaagagcagcgccgaggatttgcagaaggtggctgctgatctcaggtcatccatctggaagcagatggctggtgctgggatcaagtacatcc

SEQ ID NO: 2755 - DNA, 303 bp, Glycine max
  unsure (1)..(303): unsure at all n locations
gtcgcangcacgcgtncgacgantacgtnanctcggnnttnggntccncgctnacatgggcatngnaaactgtttacgagtgagtntcctangcncanccgcaagaaaaaaatggcatctcacatcgttggatacccccgnatgggttcccaagagagagctcaagttcgctctcgagtctttctgggatggcaagagcagcgccgaggatttgcagaaggtgtcttctgatctcagggcatccatctggaagcagatggctgatgctgggatcaagtacatccccagcaacatttctctcat

SEQ ID NO: 2756 - DNA, 300 bp, Glycine max
  unsure (1)..(300): unsure at all n locations
cgtcgcatgcacgcgtacgtnagctcggnattcggctcgngcggctcgnggcttcaacttgctccctcagaagcgaagaagaagccacagagaactagtctcctaacctcacccgcaaganaaaaatggcatctcacatcgttggatacccccgtatgggtcccaagagagagctcaagttcgctctcgagtctttctgggatggcaagagcagcgccgaggatttgcagaaggtgtcttctgatctcagggcatccatctggaagcagatggctgatgctgggatcaagtacatcccca

SEQ ID NO: 2757 - DNA, 299 bp, Glycine max
  unsure (1)..(299): unsure at all n locations
tngcangcacgcgtacgtaagctcggaattcggctcgagctgcttcaacttgctccctcagaagcgaagaagaagcnacagaggnccagtctcctactctctctcacccacaagaaaaatggcatctcacatcgttggatacccccgcatgggtcccaagagagagctcaagttcgctctcgagtctttctgggatggcnngagcagcgccgaggatntgcagaaggtggctnctgatctcaggncatccatctggaagcaganggctggtgcngggatcaagtacatccncagcnacn

SEQ ID NO: 2758 - DNA, 310 bp, Glycine max
  unsure (1)..(310): unsure at all n locations
tnncatgcacgcgtacgtaagctcggaattcggctcgaggctccctcngaagcgaagaagaagccacagagaactagtcnnctantctcacccgcaagaanaaaatgngcatcttcacatncgttggatacccccgtatgggtcccaagagaganctcaagttcgctctcgagtctttctgggatggcaagagcagcnccgaggatttgcagaaggtgtcttctgatctcagggcatccatctggaagcagatggctgatgctgggatcaagtacatccccagcaacactttctncgcantntgaccagg

SEQ ID NO: 2759 - DNA, 318 bp, Glycine max
  unsure (1)..(318): unsure at all n locations
acgcatgnagcgtacgtnagctcggnattcggctcgagctgcttcaacttnctccctcagaagcgaagaagaagccacagagaactantctcctactctcacccgcactaaaanaatggcatctcacatcgttggatacccccgtatnggncccaaganagagctcaagttcgctctcgagtctttctgggatngcnngancagngccgnggatttgcancaggtgtcttctgatctcanggcatccatctggnnacagatggctgntgctgggatcaagtncatccncancaacactttctctcactagnncaggtt

SEQ ID NO: 2760 - DNA, 293 bp, Glycine max
  unsure (1)..(293): unsure at all n locations
nncgtcgcangcacgcgtacgtaagctcggtaattcggctcgagnaacttgctccctcagaagcgaagnagaagccacagagnactagtctcctacttctcacccgcnaganaaanntggcatctcacatcgttggatacccccgtatgggtcccaagagagagctcaagtncnctctcnagtctttctgggatggcnagagcagcgccgaggatttgcagaaggtgtctnctnatctcagggcatccatctggaagcngatggctgatgctgggatcaagtacatccccagc

SEQ ID NO: 2761 - DNA, 302 bp, Glycine max
  unsure (1)..(302): unsure at all n locations
ngntcangcacncgtacgtnagctcggaattcnnctcgangctccctcagaagcgaagaannagccacagagaactngnctcctactctcacccgcaagaaaaaaatggcacctcanntcgttggatacccccgtatgngtcccaagagggagctcaagttcgctctcgagtcttctgggatggcaagagcagcgccgaggatttgcagaaggtgtcttctgatctcaggggcatccatctggaagcagatggctgatgctgggatcaagtacatccccagcancactttctctcactatgn

SEQ ID NO: 2762 - DNA, 311 bp, Glycine max
  unsure (1)..(311): unsure at all n locations
gatgctngcacgcgtacgtnagctcggaattnggctcgagcagagaactagtctcctactctcacccgcaagaaaaaaatngnatctcacatcgttggatacccccgtatgggtcccaagagagagcncaagttcgctctcgagttctttctnggatggcaagngcagctccgaggatttgcagaaggtgtcnnntgatctcagggcntccatctggaagcagatggctgatgctgggatcaagtacatccccngcaacantttctcnnactcntgacaaggttctcgacgcnaccgcgaaccctcggtgn

SEQ ID NO: 2763 - DNA, 298 bp, Glycine max
  unsure (1)..(298): unsure at all n locations
cncgtacgtaagctcggaattcggctcgagcnaagaanaagccacagcaganccagtctcctantctctctcanccacaananaaatngcatcncacatcgtnggatacccccgcatggntacccaanagagagnncaagttacgctctcgagtctttctgggatggcaagagcagcgccgaggatttgcagaaggtggctgctgntctcaggtcatccntctggaagcagatggctggtgctgggatcaagtacatccccancaacactttctcgttctatgaccagctgctcgacg

SEQ ID NO: 2764 - DNA, 300 bp, Glycine max
  unsure (1)..(300): unsure at all n locations
tcnangcacgcgtacgtnaagctcggaatttcggaattcggctcgagacttgctccctcagaagcgaagaagaagccacagagaaccagtctcctactctctctcacccacaagaaaaatggnatctcacatcgttggatacccccgcatgggncccaagagagagctcnagttcgntctcgagtctttctgggatggnaanagcancgncgangntttgcanaangnggctgctggtctcangncatccatctggaancngatggctggtgctgggatcnagtacatccccagcaacac

SEQ ID NO: 2765 - DNA, 330 bp, Glycine max
  unsure (1)..(330): unsure at all n locations
gtcgcatgcacgcgtacgtaagctcggaattcggctcgaggcttcaacttgctccctcagaagcgaagaagaagccacagagaactagtctccttacttctcacccgcaaganaaaaatgggcatctcacatcgttggatacccccgtatgggtcccaaganagagctcaagttcgctctcgagtctttctgggatggcaagagcagcgccgaggatttgcagaaggtgtcttctgatctcagggcatccatctggaagcagatggctgatgctgggatcaatacatccccagcaacatttctctcatatgaccagttctcggacgccac

SEQ ID NO: 2766 - DNA, 308 bp, Glycine max
  unsure (1)..(308): unsure at all n locations
ttgangcacgcgtacgtnagctcggaattcggctcgagcttcaacttgctccctcagangcgaagaagangccacagagaacnagtctcctactctcacccgcaaganaaaaatggcatctccacatcgttggatacccccgtatgggtncccaaganagagctcaagttcgctctcgagtctttctgggatggcaagagcagcgccgaggatttgcagaaggtgtcttctgatctcagggcatccatctggaagcagatggctgatgctgngantcaagtacatccccagcaacactttctctcact

SEQ ID NO: 2767 - DNA, 309 bp, Glycine max
  unsure (1)..(309): unsure at all n locations
gttnaatgcacgcgtacgtaagctcggaattcggctcgaggctccctcagaagcgaagaagaagccacagagaaccagtctcctactctctctcacccacaanaaaaatggcatctcacatcgttggatacccccgcatgggtcccaagagagagctcaagttcgctctcgagtctttctgggatggcaagagcagcgccgaggatttgcagaaggtggctgctgatctcaggttcatccatctggaagcagatggctggtgctggggatcaagtacatccccagcaacacttctcgttctatgaccag

SEQ ID NO: 2768 - DNA, 247 bp, Glycine max
  unsure (1)..(247): unsure at all n locations
ctanaactnnacnccctcagaagcgaagaagaagccacagagaactagtctcctactctcacccgcaaganaaaaatggcatctcacatcgttggatacccccgtatgggtcccaagagagagctcaagttcgtctcgagtcttnctgggatggcaagagcagcgccgaggatttgcagaaggtgtcttctgatctcagggcatccatctggaagcagatggctgangctgggntcaagtacatccc

SEQ ID NO: 2769 - DNA, 248 bp, Glycine max
  unsure (1)..(248): unsure at all n locations
gcacgcgtacgtaagctcggaattcggctcgagctccctcagaagcgaagaanaagccacagagaactagtctnctactctcannccgcaagaaaaaaatggcatctcacatcgttggatacccccgtatgggtcccaagagagagctcaagttcgctctcgagtctttctgggatggcaagagcagcgccgaggatttgcagaaggtgtcttctgatctcagggcatccatctggaagcagatggct

SEQ ID NO: 2770 - DNA, 284 bp, Glycine max
  unsure (1)..(284): unsure at all n locations
ncgttgcangcacgcgtacgtnagctcggaattnngctcgagtctgcttcaacttgctccctcagaancgaagaagaagccacagaganctagtctcctactctcacccgcaagaaaaaaatggcatctcacatcgttggntacccccgtatgggtcccaagaganagctcaagttcgctctcgagtctttctgggatggcnagngcagcgccgaggatttgcagaaggtgtcttctgatctcagggcatccatctggaagcagatggctgangctgggatcan

SEQ ID NO: 2771 - DNA, 329 bp, Glycine max
  unsure (1)..(329): unsure at all n locations
anaancaatgcaccgtacntaantcggntcnatgncgagcngaattcggctcgagctctgcttcaacttgctcccatngaagcgaanaagaagccacagannactantctcctantctcacncgcaaganaanaatggcanctcacatgcgttggatacccccntatgggtcccaagagagagctcaagttcgctctcgagtctttctgggatngcaagagnagcgccgaggatttgcngaaggngtcttctgatctcagggcatccatctggnagcanatggctgatgctnggancaagtacatccccagcaacatttctctcatagn

SEQ ID NO: 2772 - DNA, 302 bp, Glycine max
  unsure (1)..(302): unsure at all n locations
tgncgcntacntaagnncggaattcggctcgnggcgaagaagaagccacagagaaccagtctcctactctctctcacccacaagaaaaatggcatctcacatgcgttggatacccccgcatgggtacccaagagagagctcaagttcgctctcgagtctttctgggatggcaagagcagcgccgaggatttgcagaaggtggctgctgatctcaggtcatccatnctggaagcagatggctggtgctgggatcaagtacatcccnagcaacacttctcgntctatgaccagctgcnnacgcc

SEQ ID NO: 2773 - DNA, 281 bp, Glycine max
  unsure (1)..(281): unsure at all n locations
gcacgcgtacgtaagctcggaattcggctcganctcgagccgattcggctcgagttgctccctcagaagcgaagaaacngccacagagaaccagtctcctactctctctcaaccacaagaaaaatggcatctcacatcgttggatacccccgcatgggtcccaaggagagctcaagttcgctctcgagtctttctgggatggcaagagcagcgccgaggatttgcagaaggtggctgctgatctcaggtcatccatctggaagcagatggctggtgctggg

SEQ ID NO: 2774 - DNA, 286 bp, Glycine max
  unsure (1)..(286): unsure at all n locations
gtcgcangcacgcgtacgtaagctcggaattcggctcgagctctgcttcaacttgctccctcagaagcgaagaagaagccacagagaactagtctcctactctcacccgcaagaaaaaaatggcatctcacatcgttggatacccccgtatgggtcccaagagagagnncaagttcgctctcgagtctttctgggatggcaagagcagcgccgaggatttgcagaaggtgtcttctgatctcagggcaccatctggaagcagatggctgatgctgggatcaagtac

SEQ ID NO: 2775 - DNA, 310 bp, Glycine max
  unsure (1)..(310): unsure at all n locations
cncngcacncgtacgtaagctcggaattcggctcgagcttgctccctcagangcgaagaagaagccacagagaantagtctcctactctcacccgccaaganaaaaatggcattctcacatccgttggatacccccgtatgggtcccaagagagagctcaagttcgctctcgagtcttctgggatggcaagnncagcgccgaggatttgcagaaggtgtctctgatctcagggcatccatctggaagcagatggctgatgctgggatcaagtacatccccagcaacatttctctcatatgaccaggttct

SEQ ID NO: 2776 - DNA, 299 bp, Glycine max
  unsure (1)..(299): unsure at all n locations
tngcangcacgcgtacgtaagctcngaattcngcnccgagctctgcttcaacttgctccctcagaancgaagaagaagcnacagagaactagtctcctactctccacccgcaagaaaaaaatggcatctcacatcgttggatacccccgtatgggtcccaagagagagctacaagttcgctctcgagtctttctgggatggcaagagcagcgccgaggatttgcagaaggtgtcttctganctnagggcatccatctggaagcagatggcnnatgctgggatcattacatccccagcaa

SEQ ID NO: 2777 - DNA, 253 bp, Glycine max
  unsure (1)..(253): unsure at all n locations
cttgctcnntnaganncgaagaagaagccacagaggactagtctncntactgctcacccgcaagaaaaaaatggcatctcanatccgttggatacccccgtatgggtcncaanagagagctcaagttngctgctcgagtctttctgggatggcaatagcagngccgangatttgcagaaggtgtcttctgatctcagggcatccatctggaatcagatggctgatgcngggatcaagtncatccccagcaaca

SEQ ID NO: 2778 - DNA, 288 bp, Glycine max
  unsure (1)..(288): unsure at all n locations
gcaaangcacgcgagacgtaanctcggaattcggctcgagnaacttgntccctcagnagcgaagaagaagcnacananaactagtctcctacncncaaccgnaagaaaaanatggcatctcacatcgttggatacccccgtatnggtngcaanagagagctcaagttcgctctcgagtcttnctgngatggnaagannagcgccgaggatttgcagaaggtgtcttctgatctcagggcatccatctggaagcagatggctangctgggatcaagtacatcccangca

SEQ ID NO: 2779 - DNA, 320 bp, Glycine max
  unsure (1)..(320): unsure at all n locations
aaatnctanaagtcgcangcacgcgnacgtaanctcggaantcggctcgagnaacttgctccctcagaagcgaagaagaagccacanagaactagtctcctactgctcacccgcnagaaaaaaatggcatctncacatncgttggatanccccgnatgngngcccaaganagagctcaagttcgctctcgagtctttctgggatggcagnagcagcgccgaggatttgcagaaggtgtcttcnganctcagggcatccatctngaagcagatngctgatgctgggatcaagnacatctccaggaacactttctctnactn

SEQ ID NO: 2780 - DNA, 249 bp, Glycine max
  unsure (1)..(249): unsure at all n locations
ctgcntcaacttgctccctgcaganncgaancaagaagccacagagnactagtctncctactctcacccgcaananaaaaatggcatctcacatncgttggatanccccgtatgggtcccaaganagagntcaagttcgctctcgagtctttctgggatggnaagagcagcgccgaggatttgcagaaggtgtnttctgatctcagggnatncatctggaagnagatggctgatgntgggntcaagtac

SEQ ID NO: 2781 - DNA, 300 bp, Glycine max
  unsure (1)..(300): unsure at all n locations
acggcacangnacgtaanctcggaattcggctcgagcanncttgctccctcagaagcgaagaagaagccacagagaactagtctcctactnctcacccgcaagaaaaaaatggcatctcacatacgntggatacccccgnatgggtcccaagagagagctcaagttcgctctcgagtctttctgggatggcaagagcagcgccgaggatttgcagaaggtgtctcngatctcagggcatccatctggaagcagatggctgatgctgggatnagtacanncccagcaacatttctctcata

SEQ ID NO: 2782 - DNA, 262 bp, Glycine max
  unsure (1)..(262): unsure at all n locations
gtcgcangcacgcgtaacgtnaagctncggtaattcggcncgaggccacagagaactagtctncctactctcnnccgcaagaaaaaaatggcatctcacatcgttggatacccccgtatgggtcccaagagagagctcaagttcgctctcgantctttctgggatggcaagagcagcgccgaggatttgcagaaggtgtctctgatctcagggcatccatctggaagcagatgctgatgtggtcaagnactcccgcacantt

SEQ ID NO: 2783 - DNA, 242 bp, Glycine max
tcgcatgcacgcgtacgtaagctcggaattcggctcgagcaacttgctccctcagaagcgaagaagaagccacagagaaccagtctcctactctctctacacccacaagaaaaatggcatctcacatcgttggatacccccgcatgggtcccaagagagagctcaagttcgctctcgagtctttctgggatggcaagagcagcgccgaggatttgcagaaggtggctgctgatctcaggtca

SEQ ID NO: 2784 - DNA, 308 bp, Glycine max
  unsure (1)..(308): unsure at all n locations
ncgcntgcacgcgtacgtaagctcggaattcggctcgagaacttgctccctcagaagcgaagaagaagccacagagaactagtctcctactcttcacccgcaagaaaaaaatggcatctcacatcgttggatacccccgtatgggtcccaagagagagctcaagttcgctctcgagtctttctgggatggcaagagcagcgccgaggatttgcagaaggtgtcttctgatctcagggcatccatctgnancanatggctgatncngggntncagtacatccccagcaacatttcttctcatatgacca

SEQ ID NO: 2785 - DNA, 277 bp, Glycine max
  unsure (1)..(277): unsure at all n locations
cttgctccctccagaagacgaagaagaagccacagagaatagttctcctactctncacccgnaaganaaaacatggcatctcacatcgttggatacccccgtatgggtcccaagagagagctcaagttcgctctcgagtctttctgggatggcaagagcagngccgaggatttgcagaaggtgtctctgatctcagggcatcccatctggnagcagatggctgatgtgggatnngtacatcccagcaacatttctcncatcngacangttctcgacg

SEQ ID NO: 2786 - DNA, 280 bp, Glycine max
  unsure (1)..(280): unsure at all n locations
tatnaacttgctcnntcagancgcgaagaagaagncacagagaancnagtctcctantnctcacccgnaagnnaaaaatgggcatnctcncatcgttggataacccccgtatgggtnccaagagagagctcaagttcgntctncagtctttctgggatggcaagagcagcgncngaggatttgcagaaggtgtcttctgatctcaggncatccatctggaagcagatggctgntgntgggatcagtacatcccnagcaacacttctctcactatgaccag

SEQ ID NO: 2787 - DNA, 298 bp, Glycine max
  unsure (1)..(298): unsure at all n locations
gcacncgtacgtaagctcggaattcggctcgagcttgctccctcanaagcgaagnagaagccacananaaccagtctcctactctctctcacccacaaganaaatggnatctcacatcgttggntacccccgcatgggttcccaaganagagctcaagttcgctctcgagtctttctgggntggcnagagcagcgccgaggatttgcagaaggtggctgctgatctcaggtcatccaatctggaancaagattgccngatcggggatcaagctccatncccagcaacanntttttgct

SEQ ID NO: 2788 - DNA, 151 bp, Glycine max
  unsure (1)..(151): unsure at all n locations
gtcgcangcantgtacgtaagctcggaattcggctcgagatctggaagcagatggctgatgctgggatcaagtacatccccagcaacactttctctcactatgaccaggttctcgacgccaccgccaccctcggtgccgttccaccaaggt

SEQ ID NO: 2789 - DNA, 234 bp, Glycine max
  unsure (1)..(234): unsure at all n locations
gcacgcgtacgtaagctcggaattcggctcgagcttcaacttgctccctcagaagcgaagaagaagccacagagnactagtctctactcttcacccgcaanaaaaaaatgggcatctcacattcgttggatacccccgtatgggtcccaagagagagctcaagttcgctctcgagtcttcnaggatggcaagagcagcgccgaggatttgcagaaggtgtcttctgatctcagg

SEQ ID NO: 2790 - DNA, 138 bp, Glycine max
  unsure (1)..(138): unsure at all n locations
gnagaagaagccacagagaactagtctcctactctcacccgcaagaaaaaaatggcatctcacatcnttggatacccccgtatgggtcccaagagagagctcaagttcgctctcgagtctttctgggatggcaagagt

SEQ ID NO: 2791 - DNA, 152 bp, Glycine max
  unsure (1)..(152): unsure at all n locations
acacgcgtacgtaaagctncggaattcngctcgagctggaagcagatggctgatgctgggatcaagtacatccccagcaacactttctnntnactatgaccaggttctcgacgccacccgccaccctcggtgccgttccacncangnnaggn

SEQ ID NO: 2792 - DNA, 501 bp, Glycine max
  unsure (1)..(501): unsure at all n locations
gtttgatctccgtggncctatataaagagatatgangtcgnntccacgcgtangtaanactcggaattcggctcgagcaacnttccaatccttccaaccaccactantggatccttcnctcanacngtagaactgaggagggtacgccgtgagttcaaggctaacatgatctccgaggaagagtatgttaagtcaattaaggaggaaattcncaaagttgttgaacttcaanaagagcttgatattgatgttcttgttcatggagaaccagagagaaatgatatggttgagtacntcggtgagcaattgtcaggctttgccttcactgttaatgggtgggtgcaatcctatggttcccgttgtgtgaagccacnaatcatctatggtgatgtgagccgcccaaagccaatgactgtcttctggtcanctctggctcaganctttaccaagcgccnaatgaagggaatgcttaccggtccggttaccaatcccaactgggnc

SEQ ID NO: 2793 - DNA, 412 bp, Glycine max
  unsure (1)..(412): unsure at all n locations
gagaagacgacagaagggggctaaggcattgtctggcaacaaggatgtggccttcttctctgctaatgctgcanctcangcttcaaggaagtcctctccaanagtgaccaacnaggctgttcagaaggctgctgctgcattgaagggttcagatcatcnccgtgcaacaaatgtcagtgccagactggatgctcaacaaaanaagctcaaccttccaatccttccaaccaccactattggatccttccctcagactgtanaactgaggagggtacgccgtgagttcaaggctaacaagatctccgaggaagagtatgttaagtcaattaaggaggaaattcgcaaagttgttgaacttcaagaagagcttgatattgatgttcttgttcatgganaaccaanaganaaatta

SEQ ID NO: 2794 - DNA, 350 bp, Glycine max
  unsure (1)..(350): unsure at all n locations
cacactgctgttgatcttgttaacgagaccaagttggatgacgagatcaagtcatggctagcatttgctgcacaaaaaattgttgaagttaacgcattggctaaggcattgtctggcaacaaggatgtggccttcttctctgctaatgctgcagctcaggcttcaaggaagtcctctccaagagtgaccaacgaggctgttcagaaggctgctgctgcattgaagggttcagatcatcgncgtgcaacaaatgtcagtgccagactggatgctcaacaaaagaagctcaaccttccatccttccaaccaccactattggatccttccctcagactgtagaactgaggagg

SEQ ID NO: 2795 - DNA, 454 bp, Glycine max
  unsure (1)..(454): unsure at all n locations
ccacgcgtccggatcatcgccgtgcaacaaatgtcagtgccagactggatgctcaacaaaagaagctcaangttccngtccttccaaccaccactattggatccttccctcagactgtagaactgangagggtacgccgtgagttcaaggctaacaagatctccgaggaagagtatgttaagtcaattaaggaggaaattcgcaaagttgttgaacttcaanaagagcttgatattgatgttcttgttcatggagaaccagagagaaatgatntggttgagtacttcggtgagcaattgtcaggctttgccttcactgttaatgggtgggtgcaatctatgggtcccgttgtgtgaaagccaccaattcatctatgggtgaatgtgnaaancncgtccaaaagccaatgactgtcttctggtcatctntggcttaaangctttaccaaagcgct

SEQ ID NO: 2796 - DNA, 446 bp, Glycine max
  unsure (1)..(446): unsure at all n locations
cgaggctgttcagaaggctgctgctgcattgaagggttcngatcatcgccgtgcaacaaatgtcagtgccagactggattctcaacaaaagaagctcaaccttccaatcctgccaaccaccactattggatccttccctcagactgtagaactgaggagggtacgccgtgaattcaaggctaacaagatctccgaggaagagtatgtaaagtcaattaaggaggaaattcgcaaagttgttgagcttcaagaagagcttgatattgatgttcttggtcatggagaaccagagagaaatgatatggttgagtactttcggtgaacaattgtcaagctttggcntnaccggtaatgggtnggtgcaatcctatggttcccgttcgtgaaanccccgatcatttatgggaatgttagccgcccaaagccatgaccgntttttggtattt

SEQ ID NO: 2797 - DNA, 489 bp, Glycine max
  unsure (1)..(489): unsure at all n locations
ttctctgcccgttcngtacnnntctccnaattcgcnggccgacccacgcntccggcagatctgagaccacctaccagattgctttgtctatcaaggacgaagtggaagaccttgaaaaggctggcatcactgttatccaaattgatgaagctgctttgagagagggtcttccactgaggaaatcagagcaagctcactacttggactgggctgtccatgccttcagaatcaccaatgttggtgtccaggataccacccaggtacactcttttggatcatcgcaaatcactgaattagaaattttttttgttcatcctcattttcacatatgttgtaataatcaacttttcgtattgacagatccacactcacatgtgctactcgaacttcaacgacatcatccactccatcatcgacatggacgccgatgttatcaccattgagaaatctcgccccgacganaancttccgtcagtcctccgcgaangg

SEQ ID NO: 2798 - DNA, 340 bp, Glycine max
  unsure (1)..(340): unsure at all n locations
tcgcangcncgcgtacgtaagctcggaattcggctcgaggntcaagtcatggctagcttttgctgcccaaaaaattgttgaagttaacgcattggctaaagcattgtctggccacaaggatgangccttcttctctggtaatgctgctgctctggcttcaaggaagtcttctccaagagtgaccaacgaggctgttcagaaggctgctgctgcattgaagggttcagatcatcgccgtgcaanaaatgtcagtgccagactggattctcaacaaaagaagctcaaccttccaatcctgccaaccaccactattggatccttccctcagactgtagaactg

SEQ ID NO: 2799 - DNA, 317 bp, Glycine max
  unsure (1)..(317): unsure at all n locations
gtcgcangccagcgtacgtaagctcggaattcggctcgagaaatgatatggttgagtacttcggtgagcaattgtcaggctttgccttcactgttaatgggtgggtgcaatcctatggttcccgttgtgtgaagccaccaatcatctatggtgatgtgagccgcccaaagccaatgactgtcttctggtcatctctggctcagagctttaccaagcgcccaatgaagggaatgcttaccggtcctgttaccattctcaactggtcctttgttagaaatgaccaacctagatctgagaccacctaccagattgctttg

SEQ ID NO: 2800 - DNA, 317 bp, Glycine max
  unsure (1)..(317): unsure at all n locations
gtcgcngcacgcgtacgtaagctcggaattcggctcgagacgaagtggaggaccttgaaaaggctggcatcactgttatccaaattgatgaagctgctttgagagagggtctgccactgaggaaatcagaacaagctcactacttggactgggctgtccatgccttcagaatcaccaatgttggtgtgcaggataccactcagatccacacccacatgtgctactccaacttcaacgacatcatccactccatcatcgacatggacgctgatgttatcaccattgagaactctcgctccgatgagaagctcctgtca

SEQ ID NO: 2801 - DNA, 337 bp, Glycine max
  unsure (1)..(337): unsure at all n locations
cnngtcgcangcacgcntacgtaagctcggaattcggctcgaggccaccaatcatctatggtgatgtgagccgcccaaagccaatgactgtcttctggtcatctctggctcagagctttaccaagcncccaatgaagggaatgcttaccggtcctgttaccattctcaactggtcctttgttagaaatgaccaacctagatctgagaccacctaccagattgctttggctatcaaggacgaagtggaggaccttgaaaaggctggcatcactgttatccaaattgatgaagctgctttgagagagggtctgccactgaggaaatcagaacaagctcn

SEQ ID NO: 2802 - DNA, 329 bp, Glycine max
  unsure (1)..(329): unsure at all n locations
cangcacgcgtacgtaagctcggaattcggctcgagntgctgcattgaagggttcagatcatcgccgtgcaacaaatgtcagtgccagactggatgctcaacaaaagaagctcaaccttccaatccttccaaccaccactattggatccttccctcagactgtagaactgaggagggtacgccgtgagttcaaggctaacaagatctccgaggaagagtatgttaagtcaattaaggaggaaattcgcaaagttgttgaacttcaagaagagcttgatattgatgttcttgttcatggagaaccagagagaaatgatatggttgagtac

SEQ ID NO: 2803 - DNA, 314 bp, Glycine max
  unsure (1)..(314): unsure at all n locations
tcgcangcacgcgtacgtaagctcggaattcggctcgagctgaggaaatcagagcaagctcactacttggactgggctgtccatgccttcagaatcaccaatgttggtgtccaggataccacccagatccacactcacatgtgctactcgaacttcaacgacatcatccactccatcatcgacatggacgccgatgttatcaccattgagaactctcgctccgacgagaagcttctgtcagtcttccgcgaaggtgtgaagtatggtgctggaattggccctggtgtctatgacatccactccccaagaatacc

SEQ ID NO: 2804 - DNA, 328 bp, Glycine max
  unsure (1)..(328): unsure at all n locations
ctcangcacgcntacgtaanctcggaattcggctcgagngtacgccgtgaattcaaggctaacaagatctccgaggaagagtatgtaaagtcaattaaggaggaaattcgcaaagttgttgagcttcaagaagagcttgatattgatgttcttgttcatggagaaccagagagaaatgatatggttgagtacttcggtgaacaattgtcaggctttgccttcaccgttaatgggtgggtgcaatcctatggttcccgttgcgtgaagccaccgatcatctatggtgatgtgagccgcccaaagccaatgaccgtcttctggtcatctc

SEQ ID NO: 2805 - DNA, 323 bp, Glycine max
  unsure (1)..(323): unsure at all n locations
ngtcgcangcacgcgtacgtaagctcggaattcggctcgagggcattgtctggcaacaaggatgtggccttcttctctgctaatgctgcagctcaggcttcaaggaagtcctctccaagagtgaccaacgaggctgttcagaaggctgctgctgcattgaagggttcagatcatcgccgtgcaacaaatgtcagtgccagactggatgctcaacaaaagaagctcaaccttccaatccttccaaccaccactattggatccttccctcagactntagaactgaggagggtacgccgtgagttcaaggctaacaagatctccga

SEQ ID NO: 2806 - DNA, 312 bp, Glycine max
  unsure (1)..(312): unsure at all n locations
ngnncgcatgcacgcgtacgtnagctcggaattcggctcgagatatggttgagtacttcggtgagcaattgtnaggctttgccttcactgttaatgggtgggtgcnatcctatggttcccgttgtgtgaagccaccaatcatctatggtgatgtgagccgcccaaagccaatgactgtcttctggtcatctctggctcagagctttaccaagcgcccaatgaagggaatgcttaccggtcctgttaccattctcaactggtcctttgttaganatgaccaacctagatctgagaccacctaccagattgctt

SEQ ID NO: 2807 - DNA, 295 bp, Glycine max
  unsure (1)..(295): unsure at all n locations
canngacgcgtacgtnagctcggaattcggctcgaggaaatgatatggttgagtacttcggtgagcaattgtcaggctttgccttcactgttaatgggtgggtgcaatcctatggttcccgttgtgtgaagccaccaatcatctatggtgatgtgagccgcccaaagccaatgactgtcttctggtcatctctggctcagagctttaccaagcgcccaatgaagggaatgcttaccggtcctgttaccattctcaactggtcctttgttagaaatgaccaacctagatctgagac

SEQ ID NO: 2808 - DNA, 307 bp, Glycine max
gtcgcatgcacgcgtacgtaagctcggaattcggctcgagggactgggctgtccatgccttcagaatcaccaatgttggtgtccaggataccacccagatccacactcacatgtgctactcgaacttcaacgacatcatccactccatcatcgacatggacgccgatgttatcaccattgagaactctcgctccgacgagaagcttctgtcagtcttccgcgaaggtgtgaagtatggtgctggaattggccctggtgtctatgacatccactccccaagaataccaccaactgaagaaattgctga

SEQ ID NO: 2809 - DNA, 314 bp, Glycine max
gtcgcatgcacgcgtacgtaagctcgggaattcggctcgagcgcaaagttgttgagcttcaagaagagcttgatattgatgttcttgttcatggagaaccagagagaaatgatatggttgagtacttcggtgaacaattgtcaggctttgccttcaccgttaatgggtgggtgcaatcctatggttcccgttgcgtgaagccaccgatcatctatggtgatgtgagccgcccaaagccaatgaccgtcttctggtcatctctggctcagagctttaccaagcgcccaatgaagggaatgcttaccggtcctgtt

SEQ ID NO: 2810 - DNA, 306 bp, Glycine max
  unsure (1)..(306): unsure at all n locations
agncgcangcnagcgtacgtaagctcgggaattcggctcgagggagggtacgccgtgagttcaaggctaacaagatctccgaggaagagtatgttaagtcaattaaggaggaaattcgcaaagttgttgaacttcaagaagagcttgatattgatgttcttgttcatggagaaccagagagaaatgatatggttgagtacttcggtgagcaattgtcaggctttgccttcactgttaatgggtgggtgcaatcctatggttcccgttgtgtgaagccaccaatcatctatggtgatgtgagccgcc

SEQ ID NO: 2811 - DNA, 310 bp, Glycine max
  unsure (1)..(310): unsure at all n locations
acnacgcangcacgcgtacgtaagctcggaattcggctcgagctccatcatcgacatggacgctgatgttatcaccattgagaactctcgctccgatgagaagctcctgtcagtcttccgtgaaggtgtgaagtatggtgctggaattggccctggtgtctatgacatccactccccaagaataccaccaactgaagaaatcgctgacagaatcaataagatgcttgcagtgctcgagaagaacatcttgtgggtcaaccctgactgtggtctcaagacccgcaagtacactgaagtgaagccagccctc

SEQ ID NO: 2812 - DNA, 353 bp, Glycine max
  unsure (1)..(353): unsure at all n locations
nnnnnnaaaagtcgggaagtcgcangcacgcgtacgtaagctcggaattcggctcgnanctcgagccgaatcggctcgagccagattgctttggctatcaaggaagnagtggaggaccttacnaaggctggcatcactgtactccaaattgatgaagctgctttgagagagggtctgccactgaggaaatcagaacaagctcactacttggactgggctgtccatgccttcagaatcaccaatgttggtgtgcaggataccactcagatccacacccacatgtgctactccaacttcaacgacatcatccactccatcatcgacatggacgctgatgttatcaccattgagat

SEQ ID NO: 2813 - DNA, 297 bp, Glycine max
  unsure (1)..(297): unsure at all n locations
ctcnncgcgttacgtaagctcgggaattcggctcgaggctgctttgagagagggtctgccactgaggaaatcagaacaagctcactacttggactgggctgtccatgccttcagaatcaccaatgttggtgtgcaggataccactcagatccacacccacatgtgctactccaacttcaacgacatcatccactccatcatcgacatggacgctgatgttatcaccattgagaactctcgctccgatgagaagctcctgtcagtcttccgtgaaggtgtgaagtatggtgctggaat

SEQ ID NO: 2814 - DNA, 551 bp, Glycine max
  unsure (1)..(551): unsure at all n locations
gnnngagaggtttntgntangggggaagggggggnanatnntagaanngctatgacgtcgcatgcacgcgtacgtaagctcggaattcggctcgagtggacgctgatgttatcaccattgagaactctcgctccgatgagaagctcctggtcagtcttccgtgaaggtgtgaagtatggtgctggaattggccctggtgtctatgacatccactccccaagaataccaccaactgaagaaatcgctgacagaatcaataagatgcttgcagtgctcgagaagaacatcttgtgggtcaaccctgactgtggtctcaagacccgcaagtacactgaagtgaagccagccctcacaaacatggttgccgcagcaaaactcatccgtaacgaacttgccaagtgaatggtataaagaaagtagaatctacaagttcattggttctgcttttattataccnccaaggaaaaattttctatantngggtggttcaaataaccggtgtggaatatttanaggtttaacatgctctgtgagcaattgatctttctcac

SEQ ID NO: 2815 - DNA, 336 bp, Glycine max
  unsure (1)..(336): unsure at all n locations
agtcntcannnntcanacgtcgcatgcacgcgtacgtaagctcggaattcggctcgaggatcatcgccgtgcaacaaatgtcagtgccagactggattctcaacaaaagaagctcaaccttccaatcctgccaaccaccactattggatccttccctcagactgtagaactgaggagggtacgccgtgaattcaaggctaacaagatctccgaggaagagtatgtaaagtcaattaaggaggaaattcgcaaagttgttgagcttcaagaagagcttgatattgatgttcttgttcatggagaaccagagagaaatgatatggttgagtacttcgg

SEQ ID NO: 2816 - DNA, 313 bp, Glycine max
  unsure (1)..(313): unsure at all n locations
agtcgcangcacgcgtacgtaagctcggaattcggctcgagactcgaacttcaacgacatcatccactccatcatcgacatggacgccgatgttatcaccattgagaactctcgctccgacgagaagcttctgtcagtcttccgcgaaggtgtgaagtatggtgctggaattggccctggtgtctatgacatccactccccaagaataccaccaactgaagaaattgctgacagaatcaacaagatgctggcagtgctcgagangaacatcttgtgggntgaacctgactgtgggctcaagacccgtaaagtn

SEQ ID NO: 2817 - DNA, 304 bp, Glycine max
  unsure (1)..(304): unsure at all n locations
gtcgcangcacgcgtacgtaagctcggaattcggctcgagngctgctttgagagagggtcttccactgaggaaatcagagcaagctcactacttggactgggctgtccatgccttcagaatcaccaatgttggtgtccaggataccacccagatccacactcacatgtgctactcgaacttcaacgacatcatccactccatcatcgacatggacgccgatgttatcaccattgagaactctcgctccgacgagaagcttctgtcagtcttccgcgaaggtgtgaagtatggtgctggaattgg

SEQ ID NO: 2818 - DNA, 438 bp, Glycine max
  unsure (1)..(438): unsure at all n locations
ccacgcgtccgaagagagaaatgatatggntgngtttttnngagaacaatngnnangctttgcctggnaccgntaatgnntggntgcagatcctatggttnccgntgcgtgaagccaccgatcatctatggtgatgtgagccgnccaaagccaatgaccgtcttctggtcatctctggctcagagctttaccaagcgcccaatgaagggaatgcttaccggtcctgttaccattctcaactggtcctttgttagaaatgaccaacctagatctgagaccacctaccagattgctttgtctatcaaggacnaantggaagaccttgaaaagggctggcatcactgntatccaaattgatgaaactgctttgagagaagggtctttcnacttgaggaaatcaanaancaagctcactactttgnacctgggnttgtccat

SEQ ID NO: 2819 - DNA, 321 bp, Glycine max
  unsure (1)..(321): unsure at all n locations
nattacancntnagtcgcatgcacgcgtacgtaagctcggaattcggctcgaggcaaagataagcttgttgtgtccacctcctcctcccttcttcacactgctgttgatctagttaacgagaccaagttggatgatgagatcaagtcatggctagcttttgctgcccaaaaaattgttgaagttaacgcattggctaaagcattgtctggccacaaggatgaggccttcttctctggtaatgctgctgctctggcttcaaggaagtcttctccaagagtgaccaacgaggctgttcagaaggctgctgctgcattgaaggg

SEQ ID NO: 2820 - DNA, 306 bp, Glycine max
  unsure (1)..(306): unsure at all n locations
nacgtcgcangcacgcgtacgtaagctcggaattcggctcgagccaatgttggtgtccaggataccacccagatccacactcacatgtgctactcgaacttcaacgacatcatccactccatcatcgacatggacgccgatgttatcaccattgagaactctcgctccgacgagaagcttctgtcagtcttccgcgaaggtgtgaagtatggtgctggaattggccctggtgtctatgacatccactccccaagaataccaccaactgaagaaattgctgacagaatcaacaagatgctggcagtg

SEQ ID NO: 2821 - DNA, 323 bp, Glycine max
  unsure (1)..(323): unsure at all n locations
tcncatgcacgcgtacgtaagctcggaattcggctcgagctagcttttgctgcccaaaaaattgttgaagttaacgcattganctaaagcattgtctggccacaaggatgaggccttcttctctggtaatgctgctgctctggcttcaaggaagtcttctccaagagtgaccaacgaggctgttcagaaggctgctgctgcattgaagggttcagatcatcgccgtgcaacaaatgtcagtgccagactggattctcaacaaaagaagctcaaccttccaatcctgccaaccaccactattggatccttccctcagactgtag

SEQ ID NO: 2822 - DNA, 290 bp, Glycine max
  unsure (1)..(290): unsure at all n locations
acgtnagctcggaattcggctcgagcttggactgggctgtccatgccttcagaatcaccaatgttggtgngcaggataccactcagatccacacccacatgtgctactccaacttcaacgacatcatccactccatcatcgacatggacgctgatgttatcaccattgagaactctcgctccgatgagaagctcctgtcagtcttccgtgaaggtgtgaagtatggtgctggaattggccctggtgtctagacatccactccccaagaataccaccaactgaagaaatcg

SEQ ID NO: 2823 - DNA, 265 bp, Glycine max
ctgctgttgatcttgttaacgagaccaagttggatgacgagatcaagtcatggctagcatttgctgcacaaaaaattgttgaagttaacgcattggctaaggcattgtctggcaacaaggatgtggccttcttctctgctaatgctgcagctcaggcttcaaggaagtcctctccaagagtgaccaacgaggctgttcagaaggctgctgctgcattgaagggttcagatcatcgccgtgcaacaaatgtcagtgccagactgga

SEQ ID NO: 2824 - DNA, 289 bp, Glycine max
  unsure (1)..(289): unsure at all n locations
cgtcgcatgcacgcgtacgtaagctcggaattcggctcgagcaaagttgttgaacttcaagaagagcttgatattgatgttcttgttcatggagaaccagagagaaatgatatggttgagtacttcggtgagcaattgtcaggctttgccttcactgttaatgggtgggtgcaatcctatggttcccgttgtgtgaagccaccaatcatctatggtgatgtgagccgcccaaagccaatgactgtcttctggtcatctctggctcagagctttaccaagcgcccaatgn

SEQ ID NO: 2825 - DNA, 265 bp, Glycine max
  unsure (1)..(265): unsure at all n locations
gttaacgcattggctaaggcattgtctggcaacaaggatgtggccttcttctctgctaatgctgcagctcaggcttcaaggaagtcctctccaagagtgaccaacgaggctgttcagaaggctgctgctgcattgaagggttcagatcatcgccgtgcaacaaatgtcagtgccagactggatgctcaacaaaagaagctcaaccttccaatccttccaaccaccactattggntccttccctcagactgtagaactgaggaggg

SEQ ID NO: 2826 - DNA, 304 bp, Glycine max
  unsure (1)..(304): unsure at all n locations
agtcgcangcacgcgtacgtaagctcggaattcggctcgagcttcacactgctgttgatcnagttaacgagaccaagttggatgatgagatcaagtcatggctagcttttgctgcccaaaaaattgttgaagttaacgcattggctaaagcattgtctggccacaaggatgaggccttcttctctggtaatgctgctgctctggcttcaaggaagtcttctccaagagtgaccaacgaggctgttcagaaggctgctgctgcattgaagggttcagatcatcgccgtgcaacaaatgtcagtgc

SEQ ID NO: 2827 - DNA, 269 bp, Glycine max
  unsure (1)..(269): unsure at all n locations
ctggtttgantgttcttgttgagacctactttgctgacatccctgctgaggcatacaagaccctcacatctctgaatggcgtcactgcatatggatttgatttggtccgtggaaccaacactcttgatttgatcaagggtggatttcccagcggaaaatacctctttgctggagtggttgatggaaggnacatctgggccaatgaccttgctgcttctctcactaccttgcagggtcttgagggcattgtgggcaaagataagcttgtt

SEQ ID NO: 2828 - DNA, 315 bp, Glycine max
  unsure (1)..(315): unsure at all n locations
tcncatnnagcgnaggtanntacgtaagctcggaattcggctcgagtacggctgcgagaagacgacagaagggcatggagaaccagagagcaatgatatggttgagtacttcggtgagcaattgtcaggctttgccttcactgttaatgggtgggtgcaatcctatggttcccgttgtgtgaagccaccaatcatctatggtgatgtgagccgcccaaagccaatgactgtcttctggtcatctctggctcagagctttaccaagcgcccaatgaagggaatgcttaccggtcctgttaccattctcaactggtc

SEQ ID NO: 2829 - DNA, 320 bp, Glycine max
  unsure (1)..(320): unsure at all n locations
gtcgcangcacgcgtacgtnagctcggnattcggctcgagcaagcgcccaatgaagggaatgcttaccggtcctgttaccattctcaactggtcctttgttagaaatgaccaacctagatctgagaccacctaccagattgctttgtctatcaaggacgangtggaagaccttgaaaaggcggcatcactgttatccaaattgatgaagctgctttgagagagggtcttccactgaggaaatcagagcaagctcactacttggactgggctgtccatgccttcagaatcaccaatgttggtgtccaggataccacccaga

SEQ ID NO: 2830 - DNA, 512 bp, Glycine max
  unsure (1)..(512): unsure at all n locations
gnngnnggntntganaggggnaaggggggaantttagaacagctatgacgtcgcatgcacgcgtacgtaagctcggaattcggctcgagcaaggttcttgctgtctacaaggaagttattgctgaccttaaggcagctggtgcttcatggattcagtttgatgagcctacccttgtcttggaccttgagtctcacaagttgcaagcattcactgacgcatatgcagaacttgcgcctgctttgtctggtttgaatgttcttgttgagacctactttgctgacatccctgctgaggcatacaagaacccttacatnttcttgaatggcgtcactgcatatggatttgatttggtccgtggaaccaacactcttgatttgatcaagggtggatttccagcggaaaatacctctttcttggaatgggttgatggaaggacatttgggccaatgaccttgctggtttttttaatacctgcagggcttgaagggcatttgggccaaaataacctgtt

SEQ ID NO: 2831 - DNA, 325 bp, Glycine max
  unsure (1)..(325): unsure at all n locations
nnngtcgcangcacgcgtacgtaagctcggaattcggctcgaggttgagtacttcggtgaacaattgtcaggctttgccttcaccgttaatgggtgggtgcaatcctatggttcccgttgcgtgaagccaccgatcatctatggtgatgtgagccgcccaaagccaatgaccgtcttctggtcatctctggctcagagctttaccaagcgcccaatgaagggaatgcttaccggtcctgttaccattctcaactggtcctttgttagaaatgaccaacctagatngagaccactaccagattgctttgtctatcaaggacgaagg

SEQ ID NO: 2832 - DNA, 323 bp, Glycine max
  unsure (1)..(323): unsure at all n locations
nnnaagcntcangnacgcgtacgtnagctcggaattcggctcgagggcttcaaggaagtcctctccaagagtgaccaacgaggctgttcagaaggctgctgctgcattgaagggttcagatcntcgccgtgcaacaaatgtcagtgccagactggatgctcaacaaaagaagctcaaccttccaatccttccaaccaccactattggntccttccctcagactgtagaactgaggagggaccgccgtgagttcaaggctaacaagatctccgaggaagagtatgttaagtcaattaaggaggaaattcgcaaagttgttgaan

SEQ ID NO: 2833 - DNA, 296 bp, Glycine max
gtcgcatgcacgcgtacgtaagctcggaattcggctcgagagtcaattaaggaggaaattcgcaaagttgttgaacttcaagaagagcttgatattgatgttcttgttcatggagaaccagagagaaatgatatggttgagtacttcggtgagcaattgtcaggctttgccttcactgttaatgggtgggtgcaatcctatggttcccgttgtgtgaagccaccaatcatctatggtgatgtgagccgcccaaagccaatgactgtcttctggtcatctctggctcagagctttac

SEQ ID NO: 2834 - DNA, 265 bp, Glycine max
cgcccaatgaagggaatgcttaccggtcctgttaccattctcaactggtcctttgttagaaatgaccaacctagatctgagaccacctaccagattgctttgtctatcaaggacgaagtggaagaccttgaaaaggctggcatcactgttatccaaattgatgaagctgctttgagagagggtcttccactgaggaaatcagagcaagctcactacttggactgggctgtccatgccttcagaatcaccaatgttggtgtccagg

SEQ ID NO: 2835 - DNA, 325 bp, Glycine max
  unsure (1)..(325): unsure at all n locations
wgtngcnngcacgcgtacgtaagctcggaattcggctcgagttcccagtggaaaatacctctttgctggagtggttgatggaaggaacatctgggccaatgaccttgctgcttctctcactacattgcagggtcttgagggcattgtgggcaaagataagcttgttgtgtccacctcctcctcccttcttcacactgctgttgatcttgttaacgagaccaagttggatgacgagatcaagtcatggctagcatttgctgcacaaaaaattgttgaagttaacgcattggctaaggcattgtctggcaacaaggagtggccttct

SEQ ID NO: 2836 - DNA, 346 bp, Glycine max
  unsure (1)..(346): unsure at all n locations
gttaacgcattggctaaggcattgtctggcaacaaggatgtggccttcttctctgctaatgctgcagctcaggcttcaagnaagtcctctccnagagtgaccaacgaggctgttcagaaggctgctgctgcattgaagggttcanatcatcgccgtgcaacaaatgtcagtgccagactggatgctcaacaaaagaagctcaaccttccaatccttccaaccaccactnttgnntccttccctcagactgtagaactgaggagggtacgcgtgagttcaaggtaacaagantccgaggaagagtatgttaagnccattaaggaganatntcaagtgtgaactnaag

SEQ ID NO: 2837 - DNA, 312 bp, Glycine max
  unsure (1)..(312): unsure at all n locations
tcgcangcacgcgtacgtaagctcggaattcggctcgaggaccttgctgcttctctcactacattgcagggtcttgagggcattgtgggcaaagataagcttgttgtgtccacctcctcctcccttcttcacactgctgttgatcttgttaacgagaccaagttggatgacgagatcaagtcatggctagcatttgctgcacaaaaaattgttgaagttaacgcattggctaaggcattgtctggcaacaaggatgtggccttcttctctgctaatgctgcagctcaggcttcaaggaagtcctctccaaga

SEQ ID NO: 2838 - DNA, 307 bp, Glycine max
  unsure (1)..(307): unsure at all n locations
ntatccntnnacgtcgcangcacgcgtacgtaagctcggaattcggctcgagngagggtacgccgtgagttcaaggctaacaagatctccgaggaagagtatgttaagtcaattaaggaggaaattcgcaaagttgttgaacttcaagaagagcttgatattgatgttcttgttcatggagaaccagagagaaatgatatggttgagtacttcggtgagcaattgtcaggctttgccttcactgttaatgggtgggtgcaatcctatggttcccgttgtgtgaagccaccaatcatctatggtgatg

SEQ ID NO: 2839 - DNA, 310 bp, Glycine max
  unsure (1)..(310): unsure at all n locations
cttnnagtcncatncacnagtacgnaantcngcnnnncngttcttgttgagacctactttgctgacatccctgctgaggcatacaagaccctcacatctctgaatggcgtcactgcatatggatttgatttggtccgtggaaccaacactcttgatttgatcaagggtggatttcccagcggaaaatacctctttgctggagtggttgatggaaggaacatctgggccaatgaccttgctgcttctctcactaccttgcagggtcttgagggcattgtgggcaaagataagcttgttgtgtccacctcct

SEQ ID NO: 2840 - DNA, 297 bp, Glycine max
  unsure (1)..(297): unsure at all n locations
nttcgcatgcacgcgtacgtaagctcggaattcggctcgagcacctaccagattgctttgtctatcaaggacgangtggaagaccttgaaaaggctggcatcactgttatccaaattgatgaagctgctttgagagagggtcttccactgaggaaatcagagcaagctcactacttggactgggctgtccatgccttcagaatcaccaatgttggtgtccaggataccacccagatccacactcacatgtgctactcgaacttcaacgacatcatccactccatcatcgacatggac

SEQ ID NO: 2841 - DNA, 303 bp, Glycine max
  unsure (1)..(303): unsure at all n locations
gtcgcttnatgcacgcgtacgtaagctcggaattcggctcgagaaaaattgttgaagttaacgcattggctaaggcattgtctggcaacaaggatgtggccttcttctctgctaatgctgcagctcaggcttcaaggaagtcctctccaagagtgaccaacgaggctgttcagaaggctgctgctgcattgaagggttcagatcatcgccgtgcaacaaatgtcagtgccagactggatgctcaacaaaagaagctcaaccttccaatccttccaaccaccactattggatccttccctcaga

SEQ ID NO: 2842 - DNA, 241 bp, Glycine max
gttcttgttcatggagaaccagagagaaatgatatggttgagtacttcggtgaacaattgtcaggctttgccttcaccgttaatgggtgggtgcaatcctatggttcccgttgcgtgaagccaccgatcatctatggtgatgtgagccgcccaaagccaatgaccgtcttctggtcatctctggctcagagctttaccaagcgcccaatgaagggaatgcttaccggtcctgttaccattc

SEQ ID NO: 2843 - DNA, 296 bp, Glycine max
  unsure (1)..(296): unsure at all n locations
ntgcngcgtangtaagctcggaattcggctcgagtcaggccttcttctctgctaatgctgcagctcaggcttcaaggaagtcctctccaagagtgaccaacgaggctgttcagaaggctgctgctgcattgaagggttcagatcatcgccgtgcaacaaatgtcagtgccagactggatgctcaacaaaagaagctcaaccttccaatccttccaaccaccactattggntccttccctcagactgtagaactgaggagggtacgccgtgagttcaaggctancaagatctccgag

SEQ ID NO: 2844 - DNA, 265 bp, Glycine max
  unsure (1)..(265): unsure at all n locations
cgcccaatgaagggaatgcttaccggtcctgttaccattctcaactggtcctttgttagaaatgaccaacctagatctgagaccacctaccagattgntttgtctatcaaggacgaagtggaagaccttgaaaaggctggcatcactgttatccaaattgatgaagctgctttgagagagggtcttccactgaggaaatcagagcaagctcactacttggactgggctgtccatgccttcagaatcaccaangttggtgtccagg

SEQ ID NO: 2845 - DNA, 315 bp, Glycine max
  unsure (1)..(315): unsure at all n locations
atntgtcgcatgcncgcgtacgtaagctcggnattcggctcgagngacatcatccactccatcatcgacaggncgccgatgttatcaccattgagaantctcgctccgacgagangcttctgtcagtcttccgcgaaggtgtgangtatggtgctggaattggccctggtgtctatgacatccactccccaagaataccaccaactgaaganattgctgacagaatcaacaagatgctggcagtgctcgagaagnacatcttgtgggtganccctgactgtgggctcaagacccgtaagtacactgaggtgaagc

SEQ ID NO: 2846 - DNA, 311 bp, Glycine max
  unsure (1)..(311): unsure at all n locations
ngncatgcacgcgtacgtaagctcggaattnggctcgagtcagatcatcgccgtgcaacaaatgtcagtgccagactggattctcaacaaaagaagctcaaccttccaatcctgccaaccaccactattggatccttccctcagactgtagaactgaggagggtacgccgtgaattcaaggctaacaagatctccgaggaagagtatgtaaagtcaattaangaggaanttcgcaaagttgttgagcttcaagaagagcttgatatngatgttcttgttcatggagaaccagagagaaatgatatggttgn

SEQ ID NO: 2847 - DNA, 256 bp, Glycine max
gaagccaccgatcatctatggtgatgtgagccgcccaaagccaatgaccgtcttctggtcatctctggctcagagctttaccaagcgcccaatgaagggaatgcttaccggtcctgttaccattctcaactggtcctttgttagaaatgaccaacctagatctgagaccacctaccagattgctttgtctatcaaggacgaagtggaagaccttgaaaaggctggcatcactgttatccaaattgatgaagctgct

SEQ ID NO: 2848 - DNA, 308 bp, Glycine max
gtcgcatgcacgcgtacgtaagctcggaattcgggctcgaggatttgatcaagggtggatttcccagcggaaaatacctctttgctggagtggttgatggaaggaacatctgggccaatgaccttgctgcttctctcactaccttgcagggtcttgagggcattgtgggcaaagataagcttgttgtgtccacctcctcctcccttcttcacactgctgttgatctagttaacgagaccaagttggatgatgagatcaagtcatggctagcttttgctgcccaaaaaattgttgaagttaacgcatgg

SEQ ID NO: 2849 - DNA, 292 bp, Glycine max
  unsure (1)..(292): unsure at all n locations
acaagnannangtacgtaagctcgggaattcggctcgagccttcttctctgctaatgctgcagctcaggcttcaaggaagtcctctccaagagtgaccaacgaggctgttcagaaggctgctgctgcattgaagggttcagatcatcgccgtgcaacaaatgtcagtgccagactggatgctcaacaaaagaagctcaaccttccaatccttccaaccaccactattggatccttccctcagactgtagaactgaggagggtacgccgtgagttcaaggctaacaagatctc

SEQ ID NO: 2850 - DNA, 292 bp, Glycine max
  unsure (1)..(292): unsure at all n locations
cgcangcacncgtacgtaagctcggaattcggctcgagccactgaggaaatcgaacaagctcactacttggactgggctgtccatgccttcagaatcaccaatgttggtgtgcaggataccactcagatccacacccacatgtgctactccaacttcaacgacatcatccactccatcatcgacatggacgctgatgttatcaccattgagaactctcgctccgatgagaagctcctgtcagtcttccgtgaaggtgtgaagtatggtgctggaattggccctggtgtctat

SEQ ID NO: 2851 - DNA, 327 bp, Glycine max
  unsure (1)..(327): unsure at all n locations
gtcncangcacgcntacgtaanctcggaattcggctcgagaaatgatatggttgagtacttcggtgaacaattgtcaggctttgccttcaccgttaatgggtgggtgcaatcctatggttcccgttgcgtgaagccaccgatcatctatggtgatgtgagccgcccaaagccaatnaccgtcttctggtcatctctggctcagagctttaccaagcgcccaatgaagggaatgcttaccggtcctgttaccattctcaactggtcctttgttagaaatgaccaacctangtataaactccacaccgaaaaatgaacatcaaggaggg

SEQ ID NO: 2852 - DNA, 345 bp, Glycine max
  unsure (1)..(345): unsure at all n locations
gtcgcangcncgcgtacgtnagctcngaattcggctcgagcnnagaccctcacatctctgaatnggcgtcactgcatatgggtttgatttggtccgtggaacccatactcttgatttgatcaagggtggatttcccagtggaaaatacctctttgctggagtggttgatggaaggnacatctgggccaatgaccttgctgcttctctcactacattgcagggtcttgagggcattgtgggcaaagataagcttgttgtgtccacctcctcctcccttcttcacactgctgttgatcttgttaacgagaccaagttggatgacgagatcaagtcatggctagcatt

SEQ ID NO: 2853 - DNA, 309 bp, Glycine max
  unsure (1)..(309): unsure at all n locations
gtcgcnngcacgcgtacgtaagctcggaattcggctcgaggctgttcagaaggctgctgctgcattgaagggttcagatcatcgccgtgcaacaaatgtcagtgccagactggatgctcaacaaaagaagctcaaccttccaatccttccaaccaccactattggatccttccctcagactgtagaactgaggagggtacgccgtgagttcaaggctaacaagatctccgaggaagagtatgttaagtcaattaaggaggaaattcgcaaagttgttgaacttcaagaagagcttgatattgatgttct

SEQ ID NO: 2854 - DNA, 311 bp, Glycine max
  unsure (1)..(311): unsure at all n locations
gtcgcangcacgcgtacgtaagctcggaattcggctcgaggtgaagccaccaatcatctatggtgatgtgagccgcccaaagccaatgactgtcttctggttcatctctggctcagagctttaccaagcgcccaatgaagggaatgcttaccggtcctgttaccattctcaactggtcctttgttagaaatgaccaacctagatctgagaccacctaccagattgctttggctatcaaggacgaatggaggaccttgaaaaggctggcatcactgttatccaaattgatgaagctgctttgagagagggtc

SEQ ID NO: 2855 - DNA, 324 bp, Glycine max
  unsure (1)..(324): unsure at all n locations
gtcgcngcacgcgtacgtaagctcggaattcggctcgagccactccatcatcgacatggacgctgatgttatcaccattgagaactctcgctccgatgagaagctcctgtncagtcttccgtgaaggtgtgaagtatggtgctggaattggccctggtgtctatgacatccactccccaagaataccaccaactgaagaaatcgctgacagaatcaataagatgcttgcagtgctcgagaagaacatcttgtgggtcaaccctgactgtggttcaagacccgcaagtacactgaagtgaagccagcccctnacaaacatggttg

SEQ ID NO: 2856 - DNA, 311 bp, Glycine max
  unsure (1)..(311): unsure at all n locations
tcgcangcacgcgtacgtaagctcggaattcggctcgagccttgaaaaggctgggcatcactgttatccaaattgatgaagctgctttgagaganggtcttccactgaggaaatcagagcaagctcactacttggactgggctgtccatgccttcagaatcaccaatgttggtgtccaggataccacccagatccacactcacatgtgctactcgaacttcaacgacatcatccactccatcatcgacatggacgccgatgtttcaccattgagaactctcgctccgacgagaagcttctgtcagtcttcc

SEQ ID NO: 2857 - DNA, 258 bp, Glycine max
  unsure (1)..(258): unsure at all n locations
ccgatgttatcaccattgagaactctcgctccgacgagaagcttctgtcagtcttccgcgaaggtgtgaagtatggtgctggaattggccctggtgtctatgacatccactccccaagaataccaccaactgaagaaattgctgacagaatcaacaagatgctggcagtgctcgagaagaacatcttgtgggtgaaccctgactgtgggctcaagacccgtaagtacactgaggtgaagccagccctanaaananggt

SEQ ID NO: 2858 - DNA, 282 bp, Glycine max
  unsure (1)..(282): unsure at all n locations
acgtcgcangcacgcgtacgtaagctcggaattcggctcgaggagaaatgatatggttgagtacttcggtgaacaattgtcaggctttgccttcaccgttaatgggtgggtgcaatcctatggttcccgttgcgtgaagccaccgatcatctatggtgatgtgagccgcccaaagccaatgaccgtcttctggtcatctctggctcagagctttaccaagcgcccaatgaagggaatgcttaccggtcctgttaccattctcaactggtcctttgttagaaa

SEQ ID NO: 2859 - DNA, 297 bp, Glycine max
  unsure (1)..(297): unsure at all n locations
gcacgcgtacgtnagctcggaattcggctcgaggcttctctcactacattgcagggtcttgagggcattgtgggcaaagataagcttgttgtgtccacctcctcctcccttcttcacactgctgttgatcttgttaacgagaccaagttggatgacgagatcaagtcatggctagcatttgctgcacaaaaaattgttgaagttaacgcattggctaaggcattgtctggcaacaaggatgtggccttcttctctgctaatgctgcagctcaggcttcaaggaagtcctctccaaga

SEQ ID NO: 2860 - DNA, 286 bp, Glycine max
cacgcgtacgtaagctcggaattcggctcgaggcgcccaatgaagggaatgcttaccggtcctgttaccattctcaactggtcctttgttagaaatgaccaacctagatctgagaccacctaccagattgctttgtctatcaaggacgaagtggaagaccttgaaaaggctggcatcactgttatccaaattgatgaagctgctttgagagagggtcttccactgaggaaatcagagcaagctcactacttggactgggctgtccatgccttcagaatcaccaatg

SEQ ID NO: 2861 - DNA, 303 bp, Glycine max
  unsure (1)..(303): unsure at all n locations
cgcatgcncgcgtacgtaagctcggaattcggctcgagaagcattgtctggncacaaggatgaggccttcttctctggtaatgctgctgctctggcttcaaggaagtcttctccaagagtgaccaacgaggctgtncagaaggctgctgctgcattgagggttcagatcatcgccgtgcaacaaatgtcagtgccagactggattctcaacaaaagaagctcaaccttccaatcctgccaaccaccactattggatccttccctcagactgtagaactgaggagggtacgccgtgaattcaag

SEQ ID NO: 2862 - DNA, 311 bp, Glycine max
  unsure (1)..(311): unsure at all n locations
gtcgcangcacgcgtacgtaagctcggaattcgngctcgagtcaccattgagaactctcgctccgatgagaagctcctgtcagtcttccgtgaaggtgtgaagtatggtgctggaattggccctggtgtctatgacatccactccccaagaataccaccaactgaagaaatcgctgacagaatcaataagatgcnngcagtgctcgagaagaacatcttgtgggtcaaccctgactgtggtctccaagacccgcaagtacactgaagtgaagccagccctcacaaacatggttgccgcagcaaaactcatc

SEQ ID NO: 2863 - DNA, 296 bp, Glycine max
  unsure (1)..(296): unsure at all n locations
gtngcatgcanncttcggctcgaggacgagaagcttctgtcagtcttccgcgaaggtgtgaagtatggtgctggaattggccctggtgtctatgacatccactccccaagaataccaccaactgaagaaattgctgacagaatcaacaagatgctggcagtgctcgagaagaacatcttgtgggtgaaccctgactgtgggctcaagacccgtaagtacactgaggtgaagccagccctcacaaacatggttnncgcagcaaaactcatccgcaacgaacttgccaagtganggta

SEQ ID NO: 2864 - DNA, 305 bp, Glycine max
  unsure (1)..(305): unsure at all n locations
tcgcangcacgcgtacgtaagctcggaattcggctcgagncgacacctacttctccatggccagaggtaatgctaccgtgcctgctatggagatgancaantggttcgacaccaactaccactntattgtccctgaattgggccctgatgtgaacttcacctatgcttctcacaaggctgttgatgaatacaaggaggccaaggcgcttggagtggataccattcccgtactcgttggccctgttacatacttgttgctctccaagcctgccaagggagtcgagaaatccttttctctcctctct

SEQ ID NO: 2865 - DNA, 280 bp, Glycine max
  unsure (1)..(280): unsure at all n locations
tcgcangcacgcgtacgtaagctcgggaattcggctcgagcaacttcaacgacatcatccactccatcatcgacatggacgctgatgttatcaccattgagaactctcgctccgatgagaagctcctgtcagtcttccgtgaaggtgtgaagtatggtgctggaattggccctggtgtctatgacatccactccccaagaataccaccaactgaagaaatcgctgacagaatcaataagatgcttgcagtgctcgagaagaacatcttgtgggtcaaccc

SEQ ID NO: 2866 - DNA, 287 bp, Glycine max
  unsure (1)..(287): unsure at all n locations
gannctcgcgtacgtnagctcggaattcggctcgaggccacaaggatgaggccttcttctctggtaatgctgctgctctggcttcaaggaagtcttctccaagagtgaccaacgaggctgttcagaaggctgctgctgcattgaagggttcagatcatcgccgtgcaacaaatgtcagtgccagactggattctcaacaaaagaagctcaaccttccaatcctgccaaccaccactattggatccttccctcagactgtagaactgaggagggtacgccgtgaattc

SEQ ID NO: 2867 - DNA, 324 bp, Glycine max
  unsure (1)..(324): unsure at all n locations
ncntgcgtacgtaagctcggnntncggnngctcgngaattcggctcgagcaagaagagcttgatattgatgttcttgttcatggagaaccagagagaaatgatatggttgagtacttcggtgaacaattgtncaggctttgccttcaccgttaatgggtgggtgcaatcctatggttcccgttgcgtgaagccacgatcatctatggtgatgtgagccgcccaaagccaatgaccgtcttctggtcatctctggctcagagctttaccaagcgcccaatgaagggaatgcttaccggtcctgttaccattctcaactggtcctt

SEQ ID NO: 2868 - DNA, 273 bp, Glycine max
  unsure (1)..(273): unsure at all n locations
gtcnnatgcacgcgtncgtaagctcggaattcngctcgagtggagaaccagagagaaatgatatggttgagtacttcggtgagcaattgtcaggctttgccttcactgttaatgggtgggtgcaatcctatggttcccgttgtgtgaagccaccaatcatctatggtgatgtagccgcccaaagccaatgactgtcttctggtcatctctggctcagagctttaccaagcgcccaatgaagggaatgcttaccggtcctgttaccattctcaa

SEQ ID NO: 2869 - DNA, 296 bp, Glycine max
  unsure (1)..(296): unsure at all n locations
tcgcatgcacgcgtacgtnagctcggaattcggctcgagcagaaggctgctgctgcattgaagggttcagatcatcgccgtgcaacaaatgtcagtgccagactggatgctcaacaaaagaagctcaaccttccaatccttccaaccaccactattggatccttccctcagactgtagaactgaggagggtacgccgtgagttcaaggctaacaagatctccgaggaagagtatgttaagtcaattaaggaggaaattcgcaaagttgttgaacttcaagaagagcttgatattga

SEQ ID NO: 2870 - DNA, 301 bp, Glycine max
  unsure (1)..(301): unsure at all n locations
gtcgcangcacgcgtacgtaagctcggaattcggctcgagtgctgctctggcttcaaggaagtcttctccaagagtgaccaacgaggctgttcagaaggctgctgctgcattgaagggttcagatcatcgccgtgcaacaaatgtcagtgccagactggattctcaacaaaagaagctcaaccttccaatcctgccaaccaccactattggatccttccctcagactgtagaactgaggagggtacgccgtgaattcaaggctaacaagatctccgaggaagagtatgtaaagtcaattaa

SEQ ID NO: 2871 - DNA, 300 bp, Glycine max
  unsure (1)..(300): unsure at all n locations
cgtcgcangcacgcgtacgtnagctcggaattcggctcgangcagaacttgcgcctgctttgtctggtttgaatgttcttgttgagacctactttgctgacatccctgctgaggcatacaagaccctcacatctctgaatggcgtcactgcatatggatttnatttggtccgtggaaccaacactcttgatttgatcaagggtggatttcccagcggaaaatacctctttgctggagtggttgatggaaggaacatctgggccaatgaccttgctgcttctctcactaccttgcagggtc

SEQ ID NO: 2872 - DNA, 558 bp, Glycine max
  unsure (1)..(558): unsure at all n locations
gagangcgctgtcttnancngntgctgttcngcntccctccggaattcccgggtcgacccangcgtacgcncacgcntccagagtgaccaacgangctgttcataaagctgctgctgcattgaangactgggatggnctccgtgcaacaaatgtcagtgccagactggattctcaacanaagaagctcaaccttccaatcctgccaaccaccactattggatccttncctcagactgtataactgaggagggtacnccntgaattnaaggctaacangatctccnaggaanagtatgtaaagtcaattaangaggaaattcgcaaannttgtttnaactnnaanaagagcttgatattgatgttcttgttcatggatanccanagagaaatgatatggttgagtnctttnggtgaacaaattttnaangcttttnccctttacccgntaatnggttgggtgcaatnctatnggtttcccnttgnngttaaagcctcctatcattttattggngntttttagcccntccaaangccaattgacccntctttttnttatt

SEQ ID NO: 2873 - DNA, 279 bp, Glycine max
  unsure (1)..(279): unsure at all n locations
cgtnagctcggaattcggctcgagggagaaccagagagaaatgatatggttgagtacttcggtgagcaattgtccaggctttgccttcactgttaatgggtgggtgcaatcctatggttcccgttgtgtgaagccaccaatcatctatggtgatgtgagccgcccaaagccaatgactgtcttctggtcatctctggctcagagctttaccaagcgcccaatgaagggaatgcttaccggtcctgttaccattctcaatggtcctttgttagaaatgac

SEQ ID NO: 2874 - DNA, 295 bp, Glycine max
  unsure (1)..(295): unsure at all n locations
acgcgnacgtaagctcgggaattcggctcgagcctagatctgagaccacctaccagattgctttgtctatcaaggacgaagtggaagaccttgaaaaggctggcatcactgttatccaaattgatgaagctgctttgagagagggtcttccactgagganatcagancaagctcactacttggactgggctgtccatgccttcagaatcaccaatgttggtgtccaggataccacccagatccacactcacatgtgctactcgaattcaacgacatcatccactccatcatcgag

SEQ ID NO: 2875 - DNA, 303 bp, Glycine max
  unsure (1)..(303): unsure at all n locations
nttngcacgcgtacgtaagctcggaattcggctcgagcttgctgtctacaaggaagttattgctgaccttaaggcagctggtgcttcatggattcagtttgatgagcctacccttgtcttggaccttgagtctcacaagttgcaagcattcactgacgcatatgcagaacttgcgcctgctttgtctggtttgaatgttcttgttgagacctactttgctgacatccctgctgaggcatacaagaccctcacatctctgaatggcgtcactgcatatggatttgatttggtccgtggaaccaa

SEQ ID NO: 2876 - DNA, 293 bp, Glycine max
  unsure (1)..(293): unsure at all n locations
anngnganacgtcgcangcacgcgtacgtaagctcggaattcggctcgagncactcacatgtgctactcgaacttcaacgacatcatccactccatcatcgacatggacgccgatgttatcaccattgagaactctcgctccgacgagaagctnctgtcagtcttccgcgaaggtgtgaagtatggtgctggaattggccctggtgtctatgacatccantccccaagaataccaccaactgangaaattgctgacagaatcaacaagatgctggcantgctcgagaagaaca

SEQ ID NO: 2877 - DNA, 291 bp, Glycine max
  unsure (1)..(291): unsure at all n locations
gncgtcgcangcacgcgtacgtaagctcggaattcggctcgaggttagaaatgaccaacctagatctgagaccacctaccagattgctttggctatcaaggacgaagtggaggaccttgaaaaggctggcatcactgttatccaaattgatgaagctgctttgagagagggtctgccactgaggaaatcagaacaagctcactacttggactgggctgtccatgccttcagaatcaccaatgttggtgtgcaggataccactcagatccacacccacatgtgctactccaa

SEQ ID NO: 2878 - DNA, 298 bp, Glycine max
  unsure (1)..(298): unsure at all n locations
ctnanngcgtcgcangcacgcgtacgtnagctcggaattcggctcgaggggaatgcttaccggtcctgttaccattctcaactggtcctttgttagaaatgaccaacctagatctgagaccacctaccagattgctttgtctatcaaggacgaagtggaagaccttgaaaaggctggcatcactgttatccaaattgatgaagctgctttgagagagggtcttccactgaggaaatcagagcaagctcactacttggactgggctgtccatgccttcagaatcaccaatgttggtgtc

SEQ ID NO: 2879 - DNA, 310 bp, Glycine max
  unsure (1)..(310): unsure at all n locations
agtcgcangcacgcgtacgtaagctcggaattcggctcgagatgggtgggtgcaatcctatggttcncgttgtgtgaagccaccaatcatctatggtgatgtgagcngnccaaagccaatgactgtcttctggtcatctctggctcagagctttaccaagcgcccaatgaagggaatgcttaccggtcctgttaccattctcaactggtcctttgttagaaatgaccaacctagatctgagaccacctaccagattgctttggctatcaaggacgaagtgggaggaccttgaaaaggctggcatcatgtt

SEQ ID NO: 2880 - DNA, 279 bp, Glycine max
  unsure (1)..(279): unsure at all n locations
tcgatgcacgcgtacgtaagctcggaattcggctcgaggaagccaccaatcatctatggtgatgtgagccgcccaaagccaatgactgtcttctggtcatctctggctcagagctttaccaagcgcccaatgaagggaatgcttaccggtcctgttaccattctcaactggtcctttnttagaaatgaccaacctagatctgagaccacctaccagattgctttggctatcaaggacgaagtggaggaccttgaaaaggctggcatcactgttatccaa

SEQ ID NO: 2881 - DNA, 280 bp, Glycine max
  unsure (1)..(280): unsure at all n locations
tttatgcagcgtacgtnagctcggaattcggctcgaggncaattaaggaggaaattcgcaaagttgttgaacttcaagaagagcttgatattgatgttcttgttcatggagaaccagagagaaatgatatggttgagtacttcggtgagcaattgtcaggcttgccttcactgttaatgggtgggtgcaatcctatggttcccgttgtgtgaagccaccaatcatctatggtgatgtgagccgcccaaagccaatgactgtcttctggtcatctctggct

SEQ ID NO: 2882 - DNA, 344 bp, Glycine max
  unsure (1)..(344): unsure at all n locations
gtcgcatgcacgcgtacgtnagctcggaattcggctcgagnaccactattggatccttccctcagactgtagaactgaggagggtacgccgtgaattcaaggctaacaagatctccgaggaagagtatgtaaagtcaattaaggaggaaattcgcaaagttgttgagcttcaagaagagcttgatattgatgttcttgttcatggagaaccagagagaaatgatatggttgagtacttcggtgaacaattgtcaggcttgccttcaccgttaatgggtgggtgcaatcctaggttcccgttgcgtgaagccaccgatcatctatggtgagtgagccgcccaaag

SEQ ID NO: 2883 - DNA, 276 bp, Glycine max
  unsure (1)..(276): unsure at all n locations
acgngtacgtaagctcggaattcggctcgagnatggttcccgttgcgtgaagccaccgatcatctatggtgatgtgagccgcccaaagccaatgaccgtcttctggtcatctctggctcagagctttaccaagcgcccaatgaagggaatgcttaccggtcctgttaccattctcaactggtcctttgttagaaatgaccaacctagatctgagaccacctaccagattgctttgtctatcaaggacgaagtggaagaccttgaaaaggctggcat

SEQ ID NO: 2884 - DNA, 288 bp, Glycine max
  unsure (1)..(288): unsure at all n locations
gtngcangcgtacgtaagctcggaattcggctcgaggttaatgggtgggtgcaatcctatggttcccgttgtgtgaagccaccantcatctatggtgatgtgagccgcccaaagccaatgactgtcttctggtcatctctggctcagagctttaccaagcgcccaatgaagggaatgcttaccggtcctgttaccattctcaactggtcctttgttagaaatgaccaacctagatctgagaccacctaccagattgctttggctatcaaggacgaatggaggaccttg

SEQ ID NO: 2885 - DNA, 314 bp, Glycine max
  unsure (1)..(314): unsure at all n locations
nngcangcacgcntacgtnagctcggaattcggctcgagngaccttgctgcttctctcactacattgncagggtcttgagggcattgtgggcaaagataagcttgttgtgtccacctcctcctcccttcttcacactgctgttgatcttgttaacgagaccaagttggatgacgagatcaagtcatggctagcatttgctgcacaaaaaattgttgaagttaacgcattggctaaggcattgtctggcaacaaggatgtggccttcttctctgctaatgctgcagctcaggcttcaaggaagtcctctccaaga

SEQ ID NO: 2886 - DNA, 304 bp, Glycine max
  unsure (1)..(304): unsure at all n locations
gncgcatgcacgcgtacgtaagctcggaattcggctcgagcttgatttgatcaagggtggatttcccagcggaaaatacctctttgctggagtggttgatggaaggaacatctgggccaatgaccttgctgcttctctcactaccttgcagggtcttgagggcattgtgggcaaagataagcttgttgtgtccacctcctcctcccttcttcacactgctgttgatctagttaacgagaccaagttggatgatgagatcaagtcatggctagcttttgctgcccaaaaaatgttgaagttaacg

SEQ ID NO: 2887 - DNA, 275 bp, Glycine max
  unsure (1)..(275): unsure at all n locations
gtcgcangcacgcgtacgtaagctcggaattcggctcgaggcccaaagccaatgactgtcttctggtcatctctggctcagagctttaccaagcgcccaatgaagggaatgcttaccggtcctgttaccattctcaactggtcctttgttagaaatgaccaacctagatctgagaccacctaccagattgctttggctatcaaggacgaagtggaggaccttgaaaaggctggcatcactgttatccaaattgatgaagctgctttgagagaggg

SEQ ID NO: 2888 - DNA, 257 bp, Glycine max
cgcatatgcagaacttgcacctgctttgtctgatctgaatgttcttgttgagacctactttgctgacatccctgctgaggcgtacaagaccctcacatctctgaatggcgtcactgcatatgggtttgatttggtccgtggaacccatactcttgatttgatcaagggtggatttcccagtggaaaatacctctttgctggagtggttgatggaaggaacatctgggccaatgaccttgctgcttctctcactacat

SEQ ID NO: 2889 - DNA, 278 bp, Glycine max
  unsure (1)..(278): unsure at all n locations
tcgcangcacgcgtacgtaagctcggaattcggctcgagtgttcttgttgagacctactttgctgacatccctgctgnggcatacaagaccctcacatctctgaatggcgtcactgcatatggatttgatttggtccgtggaaccaacactcttgatttgatcaagggtggatttcccagcggaaaatacctctttgctggagtggttgatggaaggaacatctgggccaatgaccttgctgcttctctcactaccttgcagggtcttgagggcattg

SEQ ID NO: 2890 - DNA, 298 bp, Glycine max
  unsure (1)..(298): unsure at all n locations
ctgcacgcgtacgtaagctcggaattnggctcgagctcgagccgctcgagccgaccttgaaaaggctggcatcactgttatccaaattgatgaagctgctttgngagagggtcttccactgaggaaatcagagcaagctcactacttggactgggctgtccatgccttcagaatcaccaatgttggtgtccaggataccacccagatccacactcacatgtgctactcgaacttcaacgacatcatccactccatcatcgacatggacgccgatgttatcaccatgagaatctcgctc

SEQ ID NO: 2891 - DNA, 316 bp, Glycine max
  unsure (1)..(316): unsure at all n locations
gtcgcangcacgcgtacgtaagctcggaattcggctcgagntccgaggaagagtatgttaagtcaattaaggaggaaattcgcaaagttgttagaacttcaagaagagcttgatattgatgttcttgttcatggagaaccagagagaaatgatatggttgagtacttcggtgagcaattgtnangctttgccttcactgttaatgggtgggtgcaatcctatggttcccgttgtgtgaagccaccaatcatctatggtgatgtgagccgcccaaagccaatgactgtcttctggtcatctctggctcagagcttta

SEQ ID NO: 2892 - DNA, 289 bp, Glycine max
  unsure (1)..(289): unsure at all n locations
gtcgcangcacgcntacgtnagctcgggaattcggctcgagngactggatgctcaacaaaagaagctcaaccttccaatccttccaaccancactattggatccttccctcagactgtagaactgaggagggtacgccgtgagttcaaggctaacaagatctccgaggaagagtatgttaagtcaattaaggaggaaattcgcaaagttgttgaacttcaagaagagcttgatattgatgttcttgttcaggagaaccagagagaaatgatatggttgagtacttcggt

SEQ ID NO: 2893 - DNA, 320 bp, Glycine max
  unsure (1)..(320): unsure at all n locations
gttactgcacgngtacgtaagctcggaattnggctcgagctcgagccgctatggtgatgtgagccgcccaaagccaatgaccgtcttctggtcatctctggctcagagctttaccaagcgcccaatgaagggaatgcttaccggtcctgttaccattctcaactggtcctttgttagaaatgaccaacctagatctgagaccacntaccagattgctttgtctatcaaggacgaagtggaagaccttgaaaaggctggcatcactgttatccaaattgatgaagcgctttgagagagggtcntccactgaggaaatcaga

SEQ ID NO: 2894 - DNA, 302 bp, Glycine max
  unsure (1)..(302): unsure at all n locations
gtcgcatgcacgcgtacgtaagctcggaattcggctcgagcgttaatgggtgggtgcaatcctatggttcccgttgcgtgaagccaccgatcatctatggtgatgtgagccgcccaaagccaatgaccgtcttctggtcatctctggctcagagntttaccaagcgcccaatgaagggaatgcttaccggtcctgttaccattctcaactggtcctttgttagaaatgaccaacctagatctgagaccacctaccagattgctttgtctatcaaggacgaatggaagaccttgaaaaggctg

SEQ ID NO: 2895 - DNA, 313 bp, Glycine max
  unsure (1)..(313): unsure at all n locations
acgtcgcatgcacgcgtacgtnagctcggaattcggctcgagnttaatgggtgggtgcaatcctatggttcccgttgcgtgaagccaccgatcatctatggtgatgtgagccgcccaaagccaatgaccgtcttctggtcatctctggctcagagctttaccaagcgcccaatgaagggantgcttaccggtcctgttaccattctcaactggtcctttgttagaaatgaccaacctagatctgagaccacctaccagattgctttgtctatcaaggacgaatggaagaccttgaaaaggctggcatcatgtt

SEQ ID NO: 2896 - DNA, 312 bp, Glycine max
  unsure (1)..(312): unsure at all n locations
cantcgnangnacgcgtacgtaagctcggaattcgggtncnaggaaantacctctttgctggagtggttgatggaaggaacatctgggccaatgaccttgctgcttctctcactaccttgcagggtcttgagggcattgtgggcaaagataagcttgttgtgtccacctcctcctcccttcttcacactgctgttgatctagttaacgagaccaagttggatgatgagatcaagtcatggctagcttttgctgcccaaaaaattgttgaagttaacgcatggctaaagcatgtctggccacaaggatgaggg

SEQ ID NO: 2897 - DNA, 291 bp, Glycine max
  unsure (1)..(291): unsure at all n locations
gcngcacgcgtacgtaagctcggaattcggctcgaggattgcacccacccattaacggtgatgtgagccgcccaaagccaatgaccgtcttctggtcatctctggctcagagctttaccaagcgcccaatgaagggaatgcttaccggtcctgttaccattctcaactggtcctttgttagaaatgaccaacctagatctgagaccacctaccagattgctttgtctatcaaggacgaagtggaagaccttgaaaaggctggcatcactgttatccaaattgatgaagctg

SEQ ID NO: 2898 - DNA, 312 bp, Glycine max
  unsure (1)..(312): unsure at all n locations
agtcgcatgcacgcgtacgtaagctcggaattcggctcgagctcagatgttcnttccatcaaccactccagcnaagataancttgtngtgtccacctcctcctcnnttcttcacactgctgtngatnttgttaacgagaccaagttggatgacgagatcaagtcatggctagcatttgctgcacaaaaaattgttgaagttaacgnattggctaaggcnttgtctggcaacaaggatgtggccttcttntctgctaatgctgcagctcaggcttcaaggaagtcntctccaagagtgaccaacgaggctgtt

SEQ ID NO: 2899 - DNA, 247 bp, Glycine max
  unsure (1)..(247): unsure at all n locations
cgcatatgcagaacttgcacctgctttgtctgatctgaatgtncttgttganacctactttgctgacatccctgctgaggcgtacaagaccctcacatctctgaatggcgtcactgcatatgggtttgatttggtccgtggaacccatactcttgatttgatcaagggtggatttcccagtggaaaatacctctttgctggagtggttgatggaaggaacatctgggccaatgaccttgctgcttct

SEQ ID NO: 2900 - DNA, 317 bp, Glycine max
  unsure (1)..(317): unsure at all n locations
tcgcatncacgcgtacgtaagctcggaattcggctcgaggggaatgcttaccggtcctgttaccattctcaactggtcctttgttagaaatgaccaacctagatctgagaccacctaccagattgctttgtctatcaaggacganacnggaagaccttgaaaaggctggcanccactgttntccaaattgatgaagctgctttgagagagggtcttccactgaggaaatcagagcaagctcactacttggactgggctgtccatgccttcagaatcaccaatgttggtgtccaggataccacccagatccacactna

SEQ ID NO: 2901 - DNA, 285 bp, Glycine max
  unsure (1)..(285): unsure at all n locations
gtctatgcacgcgtacgtaagctcggaattcggctcgagcgagaccangttggatgacgagatcaagtcatggctagcatttgctgcacaaaaaattgttgaagttaacgcattggctaaggcattgtctgncaacaaggatgtggcttcttctctgctaatgctgcagctcaggcttcaaggaagtcctctccaagagtgaccaacgaggctgttcagaaggctgctgctgcattgaagggttcagatcatcgccgtgcaacaaatgtcagtgccagactggat

SEQ ID NO: 2902 - DNA, 264 bp, Glycine max
  unsure (1)..(264): unsure at all n locations
gtcgcangcacgcgtacgtaagctcggaattcggctcgagnacaagatctccgaggaagagtatgtaaagtcaattaaggaggaaattcgcaaagttgttgagcttcaagaagagcttgatattgatgttcttgttcatggagaaccagagagaaatgatatggttgagtacttcggtgaacaattgtcaggctttgccttcaccgttaatgggtgggtgcaatcctatggttcccgttgcgtgaagccaccgatcatctatgg

SEQ ID NO: 2903 - DNA, 299 bp, Glycine max
  unsure (1)..(299): unsure at all n locations
gtcgcangcacgcgtacgtaagctcggaattcggctcgagctgaattgggccctgatgtgaacttcacctatgcttctcacaaggctgttgatgaatacaaggaggccaaggcgcttggagtggataccattcccgtactcgttggccctgttacatacttgttgctctccaagcctgccaagggagtcgagaaatccttttctctcctctctctccttcccaaggttcttgctgtctacaaggaagttattgctgaccttaaggcagctggtgcttcatggattcaattgatgagcct

SEQ ID NO: 2904 - DNA, 305 bp, Glycine max
  unsure (1)..(305): unsure at all n locations
gttgcatgcagcgtacgtaagctcggaattcggctcgagggaagttattgcngaccttaaggcagctggtgcttcatggnttcaatttgatgagcctacccttgtcttggaccttgaatctcacaagttgcaagctttcactgacgcatatgcanaacttgcacctgctttgtctgatctgaatgttcttgttgagacctactttgctgacatccctgctgaggcgtacaagaccctcacatctctgaatggcgtcactgcatatgggtttgatttggtccgtggaacccatactcttgatttga

SEQ ID NO: 2905 - DNA, 299 bp, Glycine max
  unsure (1)..(299): unsure at all n locations
actacgcatgcacgcgtacgtaagctcggaattcggctcgagtctggctcagagctttaccaagcgcccaatgaagggaatgcttacncgtcctgttaccattctncaactggtcctttgttagaaatgaccaacctagatctgagaccacctaccagattgctttgtctatcaagntgaagtggaagaccttgaaaaggctggcatcactgttatccaaattgatgaagctgctttgagagagggtcttccactgaggaaatcagagcaagctcactacttggactgggctgtccatg

SEQ ID NO: 2906 - DNA, 286 bp, Glycine max
  unsure (1)..(286): unsure at all n locations
cacgcangcacgcgtacgtaagctcggaattcggctcgaggtggatttcccagtggaaaatacctctttgctggagtggttgatggaaggaacatctgggccaatgaccttgctgcttctctcactacattgcagggtcttgagggcattgtgggcaaagataagcttgttgtgtccacctcccctcccttcttcacactgctgttgatcttgttaacgagaccaagttggatgacgagatcaagtcatggctagcatttgctgcacaaaaaattgttgaagttaa

SEQ ID NO: 2907 - DNA, 313 bp, Glycine max
  unsure (1)..(313): unsure at all n locations
agtcgctgcnnncgtcggaattcggctcgaggtctacaaggaagtnattgctggaccttaaggcagctggtgcttcatggattcaatntgatgagcctacccttatcttggaccttgaatctcanaagttgcaagctttcactgacgcatatgcagaacttgcacctgctttgtctgatctgaatgtnctngtngagacncactttgctgacatccctgctgaggcgtacaagaccctcacatctctgaatggcgtcactgcatatgggtttgatttggtccgtggaacccatactcttgatttgatcaaggg

SEQ ID NO: 2908 - DNA, 274 bp, Glycine max
  unsure (1)..(274): unsure at all n locations
acgtcgcangcacgcgtacgtaagctcggaattcggctcgagtggattctcaacaaaagaagctcaaccttccaatccttccaaccaccactattggntccttccctcagactgtagaactgaggagggtacgccgtgaattcaaggctaacaagatctccgaggaagagtatgtaaagtcaattaaggaggaaattcgcaaagttgttgagcttcaagaagagcttgatattgatgttcttgttcatggagaaccagagagaaatgatatggt

SEQ ID NO: 2909 - DNA, 276 bp, Glycine max
  unsure (1)..(276): unsure at all n locations
gcatgcncgcgtncgtnagctcggaattcggctcgagtctggctcagagctttaccaagcgcccaatgaagggaatgcttaccggtcctgttaccattctcaactggtcctttgttagaaatgaccaacctagatctgagaccacctaccagattgctttgtctatcaaggacgaagtggaagaccttgaaaaggctggcatcactgttatccaaattgatgaagctgctttgagagagggtcttccactgaggaaatcagagcaagctcatactt

SEQ ID NO: 2910 - DNA, 252 bp, Glycine max
  unsure (1)..(252): unsure at all n locations
cacaagtngcaagcnttcactgacgcatatgcagaacttgcacctgctttgtctgatctgaatgttcttgttgagacctactttgctgacatccctgctgaggcgtacaagaccctcacatctctgaatggcgtcactgcatatgggtttgatttggtccgtggaacccatactcttgatttgatcaagggtggatttcccagtggaaaatacctctttgctggagtggttgatggnaggnacatctgggcc

SEQ ID NO: 2911 - DNA, 286 bp, Glycine max
  unsure (1)..(286): unsure at all n locations
gtcgcangcacgcgtacgtaagctcggaattcggctcgagattggctaaggcattgtctggcaacaaggatgtggccttcttctctgctaatgctgcagcttcaggcttcaaggaagtcctctccaagagtgaccaacgaggctgttcagaaggctgctgctgcattgaagggttcagatcatcgccgtgcaacaaatgtcagtgccagactggntgctcaacaaaagaagctcaaccttccaatccttccaaccaccactattgntccttcctcagacgtgtgaa

SEQ ID NO: 2912 - DNA, 293 bp, Glycine max
  unsure (1)..(293): unsure at all n locations
cgtcgnngcacgcgtacgtnagctcggnantnggctcgagctcgagccgcaagagtgaccaacgaggctgttcagaaggctgctgctgcattgaagggttcngatcatcgccgtgcaacaaatgtcagtgccagactggattctcaacanaagaagctcaaccttccaatcctgccaaccaccactattggatccttccctcagactgtagaactgaggagggtacgccgtgaattcnaggctaacaagatctccgaggaagagtatgtanngtcaattaaggnggaaattcg

SEQ ID NO: 2913 - DNA, 274 bp, Glycine max
  unsure (1)..(274): unsure at all n locations
gtcnaatgcacgcgtacgtaagctcggaattcggctcgagcgaggctgttcagaaggctgctgctgcattgaagggttcagatcatcgccgtgcaacaaatgtcagtgccagactggattctcaacaaaagaagctcaaccttccaatcctgccaaccaccactattggatccttccctcagactgtagaactgaggagggtacgccgtgaattcaaggctaacaagatctccgaggaagagtatgtaaagtcaattaaggaggaaattcgcaa

SEQ ID NO: 2914 - DNA, 283 bp, Glycine max
  unsure (1)..(283): unsure at all n locations
acantcatgcacgcgnagtagtcggaatncggctcgaggttgagcnncaagnagancttgatattgnngttcntgntcatggaganccanagagaaatgatatggttgagtacttcggtgaacaattgtcaggctttgctttcaccgttaatgggtgggtgcaatcctatggntcccgttgcgtgaagccancgatcatctatggtgatgtnagccgcccaaagccaatgaccgtnttctggtcatctctggctcagagctttaccaagcgccaatgaaggga

SEQ ID NO: 2915 - DNA, 534 bp, Glycine max
  unsure (1)..(534): unsure at all n locations
gagggattnnaaantctttcnanagccatgttgtncccgtttcggaattcccgctcgacccacgcgtccgnncacncgtccgctgcagaagacgactgaanggagagcttgatattgatgttcttgggcatggagaaccagagagaantgatgtggttgagtacttcggtgagcaattgtcaggctttgccttcactgttaatgggtgggtgcaatcctatggttcccgttgtgtgaanccaccnatcatctatggtgatgtgagcccccaaanccaatgactgtcttctggtcatctctggctcananctttaccaatcgcccnntgaaanggaatncttnccgggcctgttacattntnaacttgggcctttntttnaanatnancaacctatttnttannccnctncnttattnttttnncttttnaggatnatnngnttgnnnttttanaaangggttnngatnatttnttttntnnatnttnttnatnnnnnntntnntnaaangntnttntnattnngnaataanatt

SEQ ID NO: 2916 - DNA, 297 bp, Glycine max
  unsure (1)..(297): unsure at all n locations
gttaacgagaccaagcnanccatgacttgatctcatcatccaacttggtctcgttaactagatcaacagcagtgtgaagaagggaggaggagatcaagtcatggctagcttttgctgcccaaaaaattgttgaagttaacgcattggctaaagcattgtctggccacaaggatgaggccttcttctctngtaatgctgctnctctggcttcaaggaagtcttctccaagagtgaccaacgaggctgttcagaaggctgctgctgcattgaagggttcagatcatcgccgtgcaacaa

SEQ ID NO: 2917 - DNA, 410 bp, Glycine max
gtatggtgctggaattggccctggtgtctatgacatccactccccaagaataccaccaactgaagaaatcgctgacagaatcaataagatgcttgcagtgctcgagaagaacatcttgtgggtcaaccctgactgtggtcttaagacccgcaagtacactgaagtgaagccagccctcacaaacatggttgccgcagcaaaactcatccgtaacgaacttgccaagtgaatggtataagaaagtagaatctacaagttcattggttctgcttttataatacaccaaagaaaaattttctatattgggttgtttcaataaccgtgtgtggaatatttagatgttttagcatgctccgtgaacaattgatcctcctcaaaccctctccccttaattttcccaactcccggtt

SEQ ID NO: 2918 - DNA, 333 bp, Glycine max
  unsure (1)..(333): unsure at all n locations
acgtcgnatnnnngcgnaggananngtcgcangcacgcgtacgtaagctcggaattcggctcgagnnaggagggtacgccgtgagttcaaggctaacaagatctccgaggaagagtatgttaagtcaattaaggaggaaattcgcaaagttgttgaacttcaagaagagcttgatattgatgttcttgttcatggaganccngggngaantgatatggttgagtacttcggtgagcaattgtcaggcttgccttcactgttaatgggtgggtgcaatccaanggtcccgttgtgtnaagccaccaatccactatggtgatgtgagccgcccaa

SEQ ID NO: 2919 - DNA, 313 bp, Glycine max
  unsure (1)..(313): unsure at all n locations
cgtcgcgngcacgcgtacgtaagctcggganttcggctcgagcaagcncccaatgaagggantgcttaccggtcctgttaccattctcaactggtcctttgttagaaatgaccaacctagatctgagaccacctaccagattgctttgtctatcaaggacgaagtggaagaccttgaaaaggctggcatcactgttatccagnttggtgaagctgctttgagagagggtcttccactgaggaaatcagancaagctcactattggatgggtgtccatgccttcagaatcaccangttggtgtccaggatacca

SEQ ID NO: 2920 - DNA, 259 bp, Glycine max
  unsure (1)..(259): unsure at all n locations
ggatgacgagatcaagtcatggctagcatttgctgcacaaaaaattgttgaagttaacgcattggctaaggcattgtctggcaacaaggatgtggccttcttctctgctaatgctgcagctcaggcttcaaggaagtcctctccaagagtgaccaacgaggctgttcagaaggctgctgctgcattnaagggttcagntcancgncgtncaacanntcncagccnnantgganantcncnaaaaaaggctcncccnncc

SEQ ID NO: 2921 - DNA, 286 bp, Glycine max
  unsure (1)..(286): unsure at all n locations
tcgctgcacgcgtacgtnagctcggaattcggctcgagggataccgttccggtcctcgttggccctgttacatacctgttgctctccaagcctgccaagggagttgagaaatccttttctctcctctctctccttcccaaggttcttgctgtctacaaggaagttattgctgaccttaaggcagctggtgcttcatggattcagtttgatgagcctacccttgtcttggaccttgagtctcacaagttgcaagcattcactgacgcatatgcagaacttgcgcctg

SEQ ID NO: 2922 - DNA, 242 bp, Glycine max
gtgcaatcctatggttcccgttgcgtgaagccaccgatcatctatggtgatgtgagccgcccaaagccaatgaccgtcttctggtcatctctggctcagagctttaccaagccccaatgaagggaatgcttaccggtcctgttaccattctcaactggtcctttgttagaaatgaccaacctagatctgagaccacctaccagattgctttgtctatcaaggacgaatggaagaccttgaaa

SEQ ID NO: 2923 - DNA, 270 bp, Glycine max
gcgtacgtaagctcggaattcggctcgagtcagatcatcgccgtgcaacaaatgtcagtgccagactggattctcaacaaaagaagctcaaccttccaatcctgccaaccaccactattggatccttccctcagactgtagaactgaggagggtacgccgtgaattcaaggctaacaagatctccgaggaagagtatgtaagtcaattaaggaggaaattcgcaaagttgttgagcttcaagaagagcttgatattgatgttcttgttca

SEQ ID NO: 2924 - DNA, 292 bp, Glycine max
  unsure (1)..(292): unsure at all n locations
agtcnnangcacgcntacgtaagctcggaattcggctcgagggtggatttcccagtggaaaatacctctttgctggagtggttnatggaaggaacatctngngccaatgaccttgctgcttctctcactacattgcagggtcttgagggcattgtnggcaaagataagcttgttgtgtccacctcctcctcccttcttcacactgctgttgatcttgttaacgagaccaagttggatgacgagatcaagtcatggctagcatttgctgcacaaaaaattgtgaagttaacgc

SEQ ID NO: 2925 - DNA, 312 bp, Glycine max
  unsure (1)..(312): unsure at all n locations
aanatttnncgtcgcatgcatgcgtacgtaagctcggaattcggctcgaggagaaatgatatggttctccatgaacaagaacatcaatatcaagctcttcttgaagttcttgttcatggagaaccagagagacnatgatatggttgagtacttcggtgagcaattgtcaggctttgccttcactgttaatgggtgggtncnatcctatggttcccgttgtgtgaagccaccaatcatctatggtgatgtgagccgcccaaagccaatgactgtcttctggtcatctctggctcagagctttaccaagcgccc

SEQ ID NO: 2926 - DNA, 287 bp, Glycine max
  unsure (1)..(287): unsure at all n locations
tcgcangcacgcgtacgtnagctcggaattcggctcgagcaagtggttcgacaccaactaccactggnattgtccctgaattgggccctgatgtgaacttcacctatgcttctcacaaggctgttgatgaatacaaggaggccaaggcgcttggagtggataccattcccgtactcgttggccctgttacatacttgttgctctccaagcctgccaagggagtcgagaaatccttttctctcctctctctccttcccaaggttcttgctgtctacaaggaagttatt

SEQ ID NO: 2927 - DNA, 258 bp, Glycine max
  unsure (1)..(258): unsure at all n locations
aagccaccgatcatctatggtgatgtgagccgcccaaagccaatgaccgtcttctggtcatctctggctcagagctttaccaagcgcccaatgaagggaatgcttaccggtcctgttaccattctcaactggtctttgttagaaaatgaccaacctagatctgagacaactaccagattgctttgtctatccaaggacgantnggaagaccttgaaaaggctggcatcactgttatccaaattgatgaagctgctttg

SEQ ID NO: 2928 - DNA, 335 bp, Glycine max
  unsure (1)..(335): unsure at all n locations
gtcgcangcacgcgtacgtnagctcgggaattcggctcgagctggaattggccctggtgtctatgacatccactccccaagaataccaccaactgaagaaatcgctgacagaatcaataagatgcttgcagtgctcgagaagaacatcttgtgggtcaaccctgactgtggtctcaagacccgcaagtacactgaagtgaagccagccctcacaaacatggttgccgcagcaaaactcatccgtaacgaacttgccaagtgaatggtataagaaagtagaatctacaagttcattggttctgcttttataatacaccaaagaaaaattttctata

SEQ ID NO: 2929 - DNA, 279 bp, Glycine max
  unsure (1)..(279): unsure at all n locations
annntangtacgcgtacgtaagctcggaattcggctcgagcaccaactaccactttattgtccctgaattgggccctgatgtgaacttcacctatggttctcacnaggctgttgatgaatacaaggnggccaaggcgcttggagtggataccattcccgtactcgttggccctgttacatacttgttgctctccaagcctgccaagggagtcgagaaatccttttctctcctctctctccttcccaaggttcttgctgtctacaaggaagttattgctg

SEQ ID NO: 2930 - DNA, 282 bp, Glycine max
  unsure (1)..(282): unsure at all n locations
gtcgcangcacgcgtacgtnagctcggaattcggctcgagnnctcgctccgatgagaagctcctgtcagtcttccgtgaaggtgtgaagtatggtgctggaattggccctggtgtctatgacatccactccccaagaataccaccaactgaagaaatcgctgacagaatcaatacgatgcttgcagtgctcgagaagaacatcttgtgggtcaaccctgactgtggtctcaagacccgcaagtacactgaatgaagccagccctcacaaacatggttgccgg

SEQ ID NO: 2931 - DNA, 261 bp, Glycine max
  unsure (1)..(261): unsure at all n locations
ccttccaatccttccaaccaccactattggntccttccctcagactgtagaactgaggagggtacgccgtgagttcaaggctaacaagatctccgaggaagagtatgttaagtccaattaaggaggaaattcgcaaagttgttgaacttcaagaagagcttgatattgatgttcttgttcatggagaaccagagagaaatgatatggttgagtacttcggtgagcattgtcaggctttgcctcactgttaatgggtgggtg

SEQ ID NO: 2932 - DNA, 298 bp, Glycine max
  unsure (1)..(298): unsure at all n locations
ctcccnnacgtngcatgcacgcgtacgtnagctcgngaattcggctcgaggaaatccttttctctcctctctctccttcccaaggttcttgctgtctacaaggaagttattgctgaccttaaggcagctggtgcttcatggattcaatttgatgagcctacccttgtcttggaccttgaatctcacaagttgcaagctttcactgacgcatatgcagaacttgcacctgctttgtctgatctgaatgttcttgttgagacctactttgctgacatccctgctgaggcgtacaagaccc

SEQ ID NO: 2933 - DNA, 298 bp, Glycine max
  unsure (1)..(298): unsure at all n locations
tcgcangcacgcgtacgtnagctcggaattcggctcgagcttgttgctctccaagcctgccaagggagtcgagaaatccttttctctcctctctctccttcccaaggttcttgctgtctacaaggaagttattgctgaccttaaggcagctggtgcttcatggattcaatttgatgagcctacccttgtcttggaccttgaatctcacaagttgcaagctttcactgacgcatatgcagaacttgcacctgctttgtctgatctgaatgttcttgttgagactactttgctgacatcc

SEQ ID NO: 2934 - DNA, 269 bp, Glycine max
  unsure (1)..(269): unsure at all n locations
agtcgcangcacgcgtacgtaagctcggaattcggctcgagcaaggcgcttggagtggataccattcccgtactcgttggccctgttacatacttgttgctctccaagcctgccaagggagtcgagaaatccttttctctcctctctctccttcccaaggttcttgctgtctacaaggaagttattgctgaccttaaggcagctggtgcttcatggattcaatttgatgagcctacccttgtcttggaccttgaatctcacaagttgcn

SEQ ID NO: 2935 - DNA, 261 bp, Glycine max
tgctggaattggccctggtgtctatgacatccactccccaagaataccaccaactgaagaaattgctgacagaatcaacaagatgctggcagtgctcgagaagaacatcttgtgggtgaaccctgactgtgggctcaagacccgtaagtacactgaggtgaagccagccctcacaaacatggttgccgcagcaaaactcatccgcaacgaacttgccaagtgaatggtataagaaagtagaatcttccaagtcatttggtt

SEQ ID NO: 2936 - DNA, 262 bp, Glycine max
  unsure (1)..(262): unsure at all n locations
cgtncgtnagctcggaattcggctcgagcttctggtcatctctggctcagagctttaccaagcgcccaatgaagggaatgcttaccggtcctgttaccattcncaactggtcctttgttagaaatgaccaacctagatctgagaccacctaccagattgctttgtctatcaaggacgaagtggaagaccttgaaaaggctggcatcactgttatccaaattgatgaagctgctttgagagagggtctccactgaggaaatca

SEQ ID NO: 2937 - DNA, 280 bp, Glycine max
  unsure (1)..(280): unsure at all n locations
acgcgtacgtaagctcggaattcggctcgaggtgaagtatggtgctggaattggccctggtgtctatgacatccactccccaagaataccaccaactgaagaaattgctgacagaatcaacaagatgctggcagtgctcgagaagaacatcttgtgggtgaaccctgactgtgggctcaagacccgtaagtacactgaggtgaagccagccctcacaaacatggttgccgcagcaaaactncatccgcaacgaattgccaatgatggtataagaaataga

SEQ ID NO: 2938 - DNA, 244 bp, Glycine max
  unsure (1)..(244): unsure at all n locations
angnncctcacatctctgaanggcgtcactgcatatgggnttgatttgntccgtggancccatactcttgatttnatcaagggtggatttcccagtggaaaatacctctttgctggagtggttgatggaaggaacatctgggccaatgaccttgctgcttctctcactacattgcagggtcttgagggattgtgggcaaagataagcttgttgtgtccacctcctcctcccttcttcacactgc

SEQ ID NO: 2939 - DNA, 289 bp, Glycine max
  unsure (1)..(289): unsure at all n locations
tctatgcacgcgtacgtnagctcggaattcggctcgagcaatgactgtcttctggtcatctctggctcagagctttaccaagcgcccaatgaagggaatgcttaccggtcctgttaccattctcaactggtcctttgttagaaatgaccaacctagatctgagaccacctaccagattgctttggctatcaaggacgaagtggaggacctgaaaaggctggcatcactgttatccaaattgatgaagctgcttgagagagggtctgccatgaggaaatcagaacaagct

SEQ ID NO: 2940 - DNA, 301 bp, Glycine max
  unsure (1)..(301): unsure at all n locations
ncgtcgcangcacgcgtacgtnagctcggaattcggctcgagggttcccgttgcgtgaagccaccgatcatctatggtgatgtgagccgcncaaagccaatgaccgtcttctggtcgtctctggctcagagctttaccaagcgcccaatgaagggaatgcttaccggtcctgttancattctcaactggtcctttgttagaaatgaccaacctagatctncagaccacctaccagattgctttgtctatcaaggacgngtggaagaccttgaaaaggctggcatcactgttatccaaattg

SEQ ID NO: 2941 - DNA, 295 bp, Glycine max
  unsure (1)..(295): unsure at all n locations
tcgcatgcacgcgtacgtaagctcggaattcggctcgagccagattgctttggctatcaaggacgaagtggaggaccttgaaaaggctggcatcactgttatccaaattgatgaagctgctttgagagagggtctgccactgaggaaatcagaacaagctcactacttggactgggctgtccatgccttcagaatcaccaatgttggtgtgcaggataccactcagatccacacccacatgtgtactccaantcaacgacatcatnccatccatcangggatngggcggcgattt

SEQ ID NO: 2942 - DNA, 295 bp, Glycine max
  unsure (1)..(295): unsure at all n locations
cgtcgcangcacgcgtacgtnagctcggnattcggctcgagngcgtacaagancctcacatctctgaatngcgtcantgcatatgggtttgatttagtccgtggaacccatactcttgatttgatcaagggtggatttcccagtggaaaatacctctttgctggantggttnatgganggnncatctgggccaatgaccttgcngcntctctcacnacattncagggtcttgagggcattgtgggcnaagatannctngttgtgtccacctcctccncccttcntcacactgctg

SEQ ID NO: 2943 - DNA, 269 bp, Glycine max
  unsure (1)..(269): unsure at all n locations
gtcgcangcacgcgtacgtaagctcggaattcggctcgagttattgctgaccttaaggcagctggtgcttcatggattcaatttgatgagcctacccttgtcttggaccttgaatctcacaagttgcaagctttcactgacgcatatgcagaacttgcacctgctttgtctgatctgaatgttcttgttgagacctactttgctgacatccctgctgaggcgtacaagaccctcacatctctgaatggcgtcactgcatatgggtttga

SEQ ID NO: 2944 - DNA, 312 bp, Glycine max
  unsure (1)..(312): unsure at all n locations
tcgcangcacgcgtacgtaagctcggaattcggctcgagctggtgtctatgacatccactccccaagaataccaccaactgaagaaattgctgacagaatcaacaagatgctggcagtgctcgagaagaacatcttgtgggtgaaccctgactgtgggctcaagacccgtaagtacactgaggtgaagccagccctcacaaacatggttgccgcagcaaaactcatccgcaacgaacttgccaagtgaatggtataagaaagtagaatcttccaagtcatttggttctgctttatattataatacaccaaag

SEQ ID NO: 2945 - DNA, 320 bp, Glycine max
  unsure (1)..(320): unsure at all n locations
gangcacgcgtacgtnagctcggaattcggctcgagcccagcggaaaatacctctttgctgncagtggttgatggaaggaacatctggggcaatggacctttgtggnttctcctcactaccttggcagggtcttgangggcattgtgggcaaagataagcttgttgtgtccacctcctcctcccttcttcacactgctgttgacccagttaacgagaccaagttggatgatgagatcaagtcatggctagcttttgctgcccaaaaaaattgttgaagttaacgcattggctaaagcattgtctggccacaaggatgagg

SEQ ID NO: 2946 - DNA, 299 bp, Glycine max
  unsure (1)..(299): unsure at all n locations
nnangcatgcacgcgtacgtaagctnggaattcggctcgagctgaatgnngtcactgncatatgggnttgatttggtccgtggaacccatactgcttgatttgatcaagggtggatttcccagtggaaaatacctctttgctggagtggttgatggaaggaacatctgggccaatgaccttgctgcttctctcactacattgcagggtcttgagggcattgtgggcaaagataagcttgttgtgtccacctcctcctcccttcttcacactgctgttgatccttgttaacgagaccaag

SEQ ID NO: 2947 - DNA, 269 bp, Glycine max
  unsure (1)..(269): unsure at all n locations
aataatatgcacgcgtacgtaagntcggaattcggctcgagacaagttgcaagcattcactgacgcntatgcagaacttgcgcctgcttggggtggtttnaatgtncttgttgagaccgactttnctgacatccctgctgaggcatacaagaccctcacatctctgaatggcgtcactgcatatggatttgatttggtccgtggaaccaacactcttgatttgatcaagggtggatttcccancggaaaatacctctttgctggagtgg

SEQ ID NO: 2948 - DNA, 294 bp, Glycine max
tcgcatgcacgcgtacgtaagctcgggaattcggctcgagattggatccttccctcagactgtagaactgaggagggtacgccgtgagttcaaggctaacaagatctccgaggaagagtatgttaagtcaattaaggaggaaattcgcaaagttgttgaacttcaagaagagctgatattgatgttctgttcatggagaaccagagagaaatgatatggttgagtacttcggtgagcaattgtcaggctttgcttcactgttaatgggtgggtgcatcctatggttcccgttgt

SEQ ID NO: 2949 - DNA, 280 bp, Glycine max
  unsure (1)..(280): unsure at all n locations
nacntngcatgcacgcgtacgtaagctcggaattcggctcgaggttaccattctcaactggtcctttgttagaaatgaccaacctagatctgagaccacctaccagattgctttgtctnccaaggacgaagtggaagaccttgaaaagnctggcatcactgttatccaaattnatgaagctgctttganngagggtcttccactnnggaaatcagagcanntcactacttggancgggctgtccatntnttcagaatcacnnntgttggtgtccnngata

SEQ ID NO: 2950 - DNA, 274 bp, Glycine max
  unsure (1)..(274): unsure at all n locations
atgcncgcgtacgtnagctcggaattcggctcgagcattcccgtactcgttggccctgttacatacttgttgctctccaagcctgccaagggagtcgagaaatccttttctctcctctctctccttcccaaggttcttgctgtctacaaggaagttattgctgaccttaaggcagctggtgcttcatggattcaatttgatgagcctacccttgtcttggacttgaatctcacaagttgcaagctttcatgacgcatatgcagaattgcactgt

SEQ ID NO: 2951 - DNA, 270 bp, Glycine max
  unsure (1)..(270): unsure at all n locations
ncgtcgcatgcacgcgtacgtaagctcggaattcggctcgagcttgtcttggaccttgaatctcacaagttgcaagctttcactgangcatatgcagaacttgcacctgctttgtctgatctgaatgttcttgttgagacctactttgctgacatccctgctgaggcgtacaagaccctcacatctctgaatggcgtcactgcatatgggtttgatttggtccgtggaacccatactcttgatttgatcaagggtggatttcccagtgga

SEQ ID NO: 2952 - DNA, 549 bp, Glycine max
  unsure (1)..(549): unsure at all n locations
gtgggggcgngnnntttcccctangggaataagtagnactttatttnaaccnttnngaactcncgggtcgacccacgcgtccggcagatctgagaccacctaccagattgctttgtctatcaaggacgaagtggaagacctggaaanggctggcatcactgttatccanattgatgaagctgctttgagagagggtcttccactgaggaaatcagagcaagctcactacttggactgggctgtccatgccttcagaatcaccaatgttggtgtccaggataccacccaggtacactcttttggatcatcgcanatcactgaattanaaattttttttgttnatcctnattttcacatatgtttggnataancaantttncgtatngacagatccannactcanatgtgnctactcggacttcaancgactntnntccaattncattanntnancntggantgcntgangtntatgnncnnnttnnnanntttntgtngnatganaagtaggttnntnttnatngntatagtnnnanggttttnttgtng

SEQ ID NO: 2953 - DNA, 317 bp, Glycine max
  unsure (1)..(317): unsure at all n locations
nntcgcatgcatgcgtacgtnagctcggaattcggctcgagctcgagccgattcggctcgagttccaatcctgctcaaccaccacnnttggatccttccctacagactgtagaactgagganggtacgccgtgaattcnaggctaacaagatctccgaggaagagtatgtnaagtcaattaaggaggaaattcgcaaagttgttgagcttcaagaagagcttgatattgatgttcttgttcatggagaaccagagagaaatgatatggttgagtnttcggtgaacaattgtcaggcttgcttcaccgttaatgggtg

SEQ ID NO: 2954 - DNA, 321 bp, Glycine max
  unsure (1)..(321): unsure at all n locations
anatcgcangcacgcntacgtaagctcggaattcggctcgagttgngcnctgntgtggacttcacctatgctttctcanaaggctgtngatgaatacnaggngggccaagggcgcttngagtggatacngttccggncctcgttggcnctgttacatagctgttgctctccaagcctgccaagggagttgngaaatcctnttctctcctctctctccntcncaaggttcttgctgtctacaaggaagttattgntgaccttaaggcagctggtgcttcatggattcagtttgatgagcctacccttggtcttggaccttgn

SEQ ID NO: 2955 - DNA, 318 bp, Glycine max
  unsure (1)..(318): unsure at all n locations
gtcgcngcangngtacgtnnagctcggaattcggctcgaggtgagggtacgccgtgaattcaaggctaacaagatctccgaggaagagtatgtaaagtcaattaagggaggaaattcgcaaagttgttgagcttcaagaagagcttgatattgatgttctgttcatggagaaccagagagaaatgatatggttgagtactcggtgaacaattgtcaggcttgcctcaccgttaatgggtgggtgcaatcctatggttcccgttgcgtgaagccaccgatcatctatggtgatgtgagccgcccaaagccatgaccgtc

SEQ ID NO: 2956 - DNA, 260 bp, Glycine max
  unsure (1)..(260): unsure at all n locations
ncgcatgcacgcgtacgtnagctcggaattcggctcgagggaggccaaggcgcttggagtggataccgttccggtcctcgttggccctgttacatacctgttgctctccaagcctgccaagggagttgagaaatccttttctctcctctctctccttcccaaggtcttgctgtctacaaggaagttattgctgaccttaaggcagctggtgcttccatggattcagttggnggagctaaccctggtctgggacctgnngt

SEQ ID NO: 2957 - DNA, 247 bp, Glycine max
  unsure (1)..(247): unsure at all n locations
cgtcgcangcacgcgtacgtaagctcggaattcggctcgagctgccactgaggaaatcagaacaagctcactaccntggactgggctgtccatgccttcagaatcnncnatnttggngngcangatacnactcagatccacacccacatgtgctactccaacttcaacgacatcatccactccatcatcgacatggacgctgatgttatcaccattgagaactctcgctccgcntgagaagctcctg

SEQ ID NO: 2958 - DNA, 187 bp, Glycine max
  unsure (1)..(187): unsure at all n locations
gggaatgcttancggtcntgttancantctcaannggtcctttgttagaaatgaccaacctagatctgagaccanctaccagattgctttgtctatcaaggacgangtggaagaccntgaaaaggctggcatcantgtnatccaaattgatgaagctgcttggagagagggttncccagtgangaat

SEQ ID NO: 2959 - DNA, 250 bp, Glycine max
  unsure (1)..(250): unsure at all n locations
aataccaccaactgaagaaattgctgacagaatcaacaagatgctggcagtgctcgagaagaacatcttgtgggtgaaccctgactgtgggctcaagacccgtaagtacactgaggtgaagccagccctcacaaacatggttgccgcagcaaaactcatccgcaacgaacttgccaagtgaatgggtataggaagtngantttccaagtnatggggtccgntttaatttaaaacccccccaaaaaaattt

SEQ ID NO: 2960 - DNA, 293 bp, Glycine max
  unsure (1)..(293): unsure at all n locations
gtcgcangcacgcgtacgtaagctcggaattcggctcganctcgagccgaatcggctcgagataccaccaactgaagaaattgccgacagaatcaacaagangctggcagtgctcgagaagaacatcttgtgggtgaaccctgactgtgggctcaagacccgtaagtacactgaggtgaagccagccctcacaaacatggttgccgcagcaaaactcatccgcaacgaacttgccaagtgaatggtataagaaagtagaatcttccaagtcatttggttctgctttatattat

SEQ ID NO: 2961 - DNA, 261 bp, Glycine max
  unsure (1)..(261): unsure at all n locations
cnagnattcactgacgcatatgnagaacttgcgccacgctttgtctggtttgacatgttcttnttgagacctactttggctgacatccctgctgaggcatacaagaccctcacatctctgaatggcgtcactgcatatggatttgatttggtccgtggaaccaanactcttgatttgatcaagggtggatttcccangggaaaatacttttttgggggantgntgatggaaggancattgggccaatgactttgctgtttt

SEQ ID NO: 2962 - DNA, 277 bp, Glycine max
  unsure (1)..(277): unsure at all n locations
ngtcgcatgcacgcgtacgtaagctcggaattcggntcgagggagtggataccgttccggtcctcgntggccctntnacatacctgttgctnctccaagcctgccaagggagttgagaaatcctttctctcctctntntncttcgnaaggntnttgcngtctanaaggaagtnattgntgaccttaaggcagctggtgcttcatggattcagtttgatgagcctacccttgtcttggaccttgngtctcacaagttgcaagcattcagtgccgcana

SEQ ID NO: 2963 - DNA, 293 bp, Glycine max
  unsure (1)..(293): unsure at all n locations
agactgtagaactgaggagggtacgccgtgagttcaaggctaacaagatcctccgaggaagagtatgttaagtccaattaaggaggaaattcgcaaagttgttgaacttcaagaagagcttgatattgatgttcttgttcatggagaaccagagagaaatgatatggttgagtacttcggtgagcaattntnaggctttgccttcactgttaatggntgggtgcantccatggttcccgttgtgtgaagcaacaatnnaccaaggnnattaacccgcccaaagccattgactt

SEQ ID NO: 2964 - DNA, 227 bp, Glycine max
  unsure (1)..(227): unsure at all n locations
accaactgaagaaattgctgacagaatcaacaagatgctggcagtgctcgagaagaacatcttgtgngtgaaccctgactgtgggctcaagacccgtaagtacactgaggtnaagccagccctcacaaacatggttgccgcagcaaaactcatccgcaacgaacttgccaagtgaatggtataagaaagtagaatcnnaccaagtcatttggttctgctttatatta

SEQ ID NO: 2965 - DNA, 290 bp, Glycine max
  unsure (1)..(290): unsure at all n locations
ntcgcangcacgcgtacgtaagctcggaattcggctcgaggtgaccaacgaggctgttcagaaggntgctgctgcattgaagggtncagatcatcgccgtgcaacaaatgtcagtgccagactggattctcaacaaaagaagctcaaccttccaatcctgnccaaccaccactatnggatccttccctcagactgtagaactgaggagggnagcngngaattcaaggctaacaagatctccgaggaagagtatgtaaagtcaattaaggaggaaattcgcaaagttgttg

SEQ ID NO: 2966 - DNA, 256 bp, Glycine max
  unsure (1)..(256): unsure at all n locations
aagacctcacatctctgantgtncgtcantgcatatgggtttgatttggtccgtggaagcatactcttgatttgatcaagggnggatttcccagtggagaatacctctttgctggagtggttgatggaangaacatcngggccaatgaccttgctgcttctcncactacatgcagggtcttgagggcattgtgggcaaagataagcttgttgtgnccacctcnncctcccttctcacactgctgtngatcntgtna

SEQ ID NO: 2967 - DNA, 330 bp, Glycine max
  unsure (1)..(330): unsure at all n locations
gtcgcatgcacgcgtacgtaagctcggaattcggctcgannctcgaaccgctcgagcggctcgancgggctcgagatccactccccactgaataccaccaactnctaganattncctgacagaatcaacaagatgcacgcagtgctcgagaagaacatcttgtgggtgaaccctgactgtgggctcaagacccgtaagtacactgaggtgaagccagccctcacaaacatggttgccgcagcaaaactcatccgcaacgaacttgccaagtgaatggtataagaaagtagaatcttccaagtcatttggttctgtttatattataataca

SEQ ID NO: 2968 - DNA, 306 bp, Glycine max
  unsure (1)..(306): unsure at all n locations
tcgcangcacgcgtacgtaagctcgggttcgacaccanctacnacatnaattgtccctgaattgggccctgatgtgaacttcacctatgncnctcacaaggctgttgatgaatacaaggaggccaaggcgcttggagtggataccgttccggtcctcgntggccctgttacatacctgttgctctccaagcctgccaagggagtnagaaagccntttcgctccnctctctccggcccaaggacttgctgtcnacaaggaagnnattgcngaccngaangcagcnggngcatcanggatcagttnga

SEQ ID NO: 2969 - DNA, 215 bp, Glycine max
  unsure (1)..(215): unsure at all n locations
tnagctcggaattcggctcgagcanggcgttggagtggataccgttccggtcctcgttggccctgttacatacctgttgctcctccaaagcctgccaagggagttgagaaatccttttctctcctctctctccttcccaaggttcttgctgtctacaaggaagttattgctgaccttaaggcagctggtgcttcatggattcagtttgatgagcc

SEQ ID NO: 2970 - DNA, 172 bp, Glycine max
  unsure (1)..(172): unsure at all n locations
ngtcgcatgcacgcgtacgtaagctcggaattcggctcgagcgcatatgcagaacttgcgcctgctttgtctggtttgaatgttcttgttgagacctactttgctgacatccctgctgaggcatacaagaccctcacatctctgaatggcgtcactgcatatggatttgatt

SEQ ID NO: 2971 - DNA, 170 bp, Glycine max
  unsure (1)..(170): unsure at all n locations
gtcgcangcacgcgtacgtaagctcggaattcggctcgagngcttctcacaaggctgttgatgaatacaaggaggccaaggcgcttggagtggataccgttccggtcctcgttggccctgttacatacctgttgctctccaagcctgccaagggagttgagaaatccttt

SEQ ID NO: 2972 - DNA, 321 bp, Glycine max
  unsure (1)..(321): unsure at all n locations
gtcgcangcncgcgtacgtnagctcgtcaattcggctcgagnacttgttngctctccaagcctgnccaagggagtcgagaaatcccttttctctcctctctctccttcccaaggttcttgctgtctacaaggaagttattgctgaccttaaggcagntggtgcttcatggattcaatttgatgagcctaccctgtctggaccttgaatctcacaagttgcaagctttcactgacgcatatgcagaacttggcacctgctttgtctgatctgaatgttcttgtngagacctatcntgctgacatccctgttgnggngtanaa

SEQ ID NO: 2973 - DNA, 236 bp, Glycine max
  unsure (1)..(236): unsure at all n locations
tacaaggaggccaaggcgcttggacgtggataccgttccggtcctgcgttggccctgttaaatacctgttgctctccangcctgncaanggagttgagaaatccttnnctctcctctctctccttcccaaggttcttgctgtctacaaggaagttattgctgaccttaaggcagtggtgcttcatggattcannttnatgagtctacnctgtnttggacttgagtctcacaagttg

SEQ ID NO: 2974 - DNA, 231 bp, Glycine max
  unsure (1)..(231): unsure at all n locations
actcnanncncncntncgtnagcncggnnttcggctcnagnttggntcnttcnctcagactgtanaacngngnagggtacgccgtnaattcaaggctaacaanatctgcngnggangagtatntaaagtcaattanggaggaaattcgcaaagttgttgagcttcaagaagagcttgatattgatgttcttgttcatggagaaccagcgananatgntatggttnagtccc

SEQ ID NO: 2975 - DNA, 313 bp, Glycine max
  unsure (1)..(313): unsure at all n locations
tnntngcacgcgtacgtaagctcggaattcggctcgagatgttgtaatatttattctgctgttactcatggcttcttttctttcctctcaggctgctgcattgaagggttcagatcatcgccgtgcaacaaatgtcagtgccagactggattctcaacaaaagaagctcaaccttccaatcctgnccaaccaccactattggatccttccctcagactgtagaactgaggagggtacgccggaattcaaggctaacaagatctccgaggaagagtatgtaaagtcaattaaggaggnnattcgcaaagttgtt

SEQ ID NO: 2976 - DNA, 184 bp, Glycine max
  unsure (1)..(184): unsure at all n locations
atncagcgtacgtaagtcggaattcggctcgagcagagtttaccaagcgcccaatgaagggaatgcttaccggtcctgttancattcttcaactggtcctttgttagaaatgaccaacctagatctgaganccantaccagattgctttnggctatcaaagacgaantngagggnncttgaaaa

SEQ ID NO: 2977 - DNA, 314 bp, Glycine max
  unsure (1)..(314): unsure at all n locations
nngtngcangcacgcgtacgtaagctcggaattcggctcgagggtgaaccctgactgtgggctcaagacccgtaagtacactgaggtgaagccagccctcacaaacatggttgccgcagcaaaactcatccgcaacgaacttgccaagtgaatggtataaganagtagaatcttccaagtcatttggttctgctttatattataatacaccaaagaaaaattttctctatattgggttgtttcaataactgtgtgtggaatatttaggtgtcttagcatgctctgtgagcaattgattcttcctcaacccctcc

SEQ ID NO: 2978 - DNA, 153 bp, Glycine max
  unsure (1)..(153): unsure at all n locations
ncgcatgcacgcgtacgtaagctcggaattcggctcgaggtgaccaacgaggctgttcagaaggctgctgctgcattgaagggttcagatcatcgccgtgcaacaaatgtcagtgccagactggatttctcaacaaaagaagctcaaccttcc

SEQ ID NO: 2979 - DNA, 280 bp, Glycine max
  unsure (1)..(280): unsure at all n locations
gtcgctgcncgcgtaagtcggctcgngnttcggntcgnggttattgctgaccttnaggcagctggtgcttcatggattcagtttgangagcctnnncttntnttggacccngnngnanaangnnngangannncgcngaggaanatgggaattntgcgcgtacttngnnnngnntgaangannntnatnanaccctctntnntggaataccnnatngngnaacccngaaccctnncatctctggaatggcgnnatgcgtatggattgatnagtcngtgga

SEQ ID NO: 2980 - DNA, 102 bp, Glycine max
  unsure (1)..(102): unsure at all n locations
cccccagtgganaatacctcnttgctggagtggttgatggaaggaacatctgggccaatgaccttgctgcttctctccactacattgcagggtcttgagggc

SEQ ID NO: 2981 - DNA, 288 bp, Glycine max
  unsure (1)..(288): unsure at all n locations
gtcgangtgcacgcgtacgtaagctcggaattcggctcgagccacagtcagggttcaagacccgtaagtacactgaggtgaagccagccctcacaaacatggttgccgcagcaaaactcatccgcaacgaacttgccaagtgaatggtataagaaagtagaatcttccaagtcatttggttctgctttatattataatacaccaaagaaaaattttccccatattgggtgnttcnataactgngngtggaatatttangtgncttagcatgctctgtgagcaattgat

SEQ ID NO: 2982 - DNA, 260 bp, Glycine max
agctcggaattcggctcgagcgtaagtacactgaggtgaagccagccctcacaaacatggttgccgcagcaaaactcatccgcaacgaacttgccaagtgaatggtataagaaagtagaatcttccaagtcatttggttctgctttatattataatacacaaagaaaaattttctctatattgggttgtttcaataactgtgtgtggaatatttaggtgtcttagcatgctctgtgagcaattgattcttcctcaacccc

SEQ ID NO: 2983 - DNA, 323 bp, Glycine max
  unsure (1)..(323): unsure at all n locations
gtcgnngcacgcgtacgtaagctcggaattcngctcgagctctgcactctctccttctcatcctcttctcttcgcttctctgttcgtgccacttcttctccgagcaatgggcatctcatattgttggttatccacgcatgggacccaagagagaacttaagtttgctttggaatctttttgggatggaaagagtagtgctgatgatctgcagaaggttgctgctgaccttaggncagccatctggaagcagatggctgatgctggaataaagtatattcctagcaacactttctcatactatgatcaagtactggacacaacn

SEQ ID NO: 2984 - DNA, 335 bp, Glycine max
  unsure (1)..(335): unsure at all n locations
ngtcgcangcacgcntacgtnagctcggaattcggctcgnnctcgctctgcactctctctttctcatcctattctcttcgcttctctgttcgtgccacttcttctncgagcaatggcatctcatattgttggttatccacgcatgggacccaagagagaacttaagtttgctttggaatctttttgggatggaaagagtagtgctgaggagctgcagaaggttgctgcagaccttaggtcagccatctggaagcagatggctgatgctggaataaagnatattcctagcaacaccttctcactttacgatcaagtatggacacaacagccatgct

SEQ ID NO: 2985 - DNA, 297 bp, Glycine max
  unsure (1)..(297): unsure at all n locations
ngtngcatgcacgcgtacgtaagctcggaattcggctcgaggtttacgatctcactctgcactctctccttctcatcctcttctcttcgcttctctgttcgtgccacttcttctcgagcaatggcatctcatattgttggttatccacgcatgggacccaanagagaacttaagtttgctttggaatctttttgggatggaaagagtagtgctgatgatctgcagaaggttgctgctgaccttaggtcagccatctggaagcagatggctgatgctggaataaagtatattcctagc

SEQ ID NO: 2986 - DNA, 327 bp, Glycine max
  unsure (1)..(327): unsure at all n locations
nnttancaagcgtangtaagctcggaattcngctcgagctcactctgcactctctcctctctcatcctcgtgtctncgcnncnntcggncngcnattccgtcccgagcnatggcatctcatattgtnggttatccacgcatggccncccangagagancttaagtnngctttggaatctttttgggatggaaagagtagtgctgatgatctgcngaaggttgctgctgaccttaggtcagccatctggaagcagatggctgatgctggaataaagtatattcctagcaacactttctcatactatgatcaagtactggacacaacag

SEQ ID NO: 2987 - DNA, 315 bp, Glycine max
  unsure (1)..(315): unsure at all n locations
cnatcgcangcangcgtacgtaagctcggaattcggctcgaggtgaagtgantagtataaatntacaaantcncctncantcattgtgtggcgccgttnacattctcgntctgcactctctctttctcatcctnntctcttcgcntctctgtncgtgccacntcttctcgagcaatggcatctcatattgttggttatcnacgcatggnacccaagagagaacgtaagttngcttnggantctntttgggatggaaagagnagtgctgaggagctgcagaaggttgctgcagaccttaggtgagccatcttgaan

SEQ ID NO: 2988 - DNA, 306 bp, Glycine max
agtcgcatgcacgcgtacgtaagctcggaattcggctcgaggattattaatcgtatcagtgaaagaagtaagaagagagagaagtgaagttagtagtataaatgtacaaactctcctctattcagtgtgtggcgccgtttacgatctcactctgcactctctccttctcatcctcttctcttcgcttctctgttcgtgccacttcttctcgagcaatggcatctcatattgttggttatccacgcatgggacccaagagagaacttaagtttgctttggaatctttttgggatggaaagagtagtg

SEQ ID NO: 2989 - DNA, 264 bp, Glycine max
  unsure (1)..(264): unsure at all n locations
gtcgcangcacgcntacgtnagctcggaattcggctcgagctctgcactctctctttcncatcctattctcttcgcttctctgtnccgtgccacttcttctcgagcaatggcatctcatattgttggttatccacgcatgggacccaanagagaacttaagtttgctttggaatctttgggatggaaagagtagtgctgaggagctgcagaaggttgctgcagaccttaggtcagccatctggaagcagatggctgatgctggn

SEQ ID NO: 2990 - DNA, 316 bp, Glycine max
  unsure (1)..(316): unsure at all n locations
tacgcgtacgtaagctcggaattcggctcgagcttctttccctaattgacaagatccttcctgtctacagggaggntgttgctgaattgaaggcagctggtgctacttggatccagtttgatgaacctacccttgtgaaggatctcaanacccaccagttacaagcatttacacatgnctatgcagagctagagtcaagtttatctggttttaatgttctgattgaganatactttgctgatgtccctgctgaagcatacaaaacactcacctctttgaaggctgttactgcatatgggtttgatattgttcgtgg

SEQ ID NO: 2991 - DNA, 321 bp, Glycine max
  unsure (1)..(321): unsure at all n locations
caanatacatgcacgcntacgtnagctcggaattcggctcgagggcagctggtgctacttggatccagtttgatgaacctacccttgtgaaggatctcaacacccaccagttacaagcatttacacatgcctatgcagagctagagtcaagtttatctggttttaatgttctgattgagacatactttgctgatgtccctgctgaagcatacaaaacactcacctctttgaaggctgttactgcatatgggtttgatattgttcgtggaacaaagaccctggatttgttcnaggcaggttttcccncggggaaatnttttt

SEQ ID NO: 2992 - DNA, 331 bp, Glycine max
  unsure (1)..(331): unsure at all n locations
ttgcangcacgcgtagtaagctcggaattcggctcgagnntctttccctaattgacaagatccttcctggtctacagggaggtngttgctgaattgaaggcagctggtgctatttggatctagtntgatgaacctaccnttgtgaaggatctcaacacccaccagttacaagcatttacacatgcctatgcaganctagagtcaagtttatctggttttaatgttctgattgagacatactttgctgatgtccctgctgaagcatacaaaacactcacctctttgaaggctgttactgcatatgggtttgatattgttcgtggaacaaaga

SEQ ID NO: 2993 - DNA, 284 bp, Glycine max
  unsure (1)..(284): unsure at all n locations
gatcgacatgcttgggctggagaataccccggcgtgaagcgcatcaccatcaagccccaaactgacagatgggtctccctgagaccaacacggtatcatgtcttggctgagggtcgattgatgaacttggatgcgcaatggaaaccccagtttggagtctgttcctcaacnaccagtcattgtcacttagtgtgaaggganatacgnagtacgagagagttagttgcccagactgagagagtgtgcnttactggcaattggactagtgccactacagccggtgt

SEQ ID NO: 2994 - DNA, 297 bp, Glycine max
  unsure (1)..(297): unsure at all n locations
cangcacgcgtacgtaagctcggnattcggctcgaggggccccgnacggcggccccgacctnatcgtcgacgacggaggcgacgccaccctcctcatccacgagggcgtcaaggccgaggagctctatgagaagaccggggaactccccgaccctaactccactnanaatncnaannntccagatcgtgcttaccnncancagngannggttgaanaccgatcncaccangtaccgnaagatgaaggnccgtctcgttggggtttctgagaaaccaacactggtgttaagagnctat

SEQ ID NO: 2995 - DNA, 318 bp, Glycine max
  unsure (1)..(318): unsure at all n locations
ngtcgcatgcacgcntacgtaagctcggaattcggctcgagtgagaagaccggggaactccccgaccctaactccactgacaacgccgagttccagatcgtgcttaccatcatcagagatgggttgaagaccgatcccaccaggtaccgcaagatgaaggagcgtctcgttggggtttctgaggaaaancaaccactggtgttaaaganggctaaatccggatgncaggngaatggggattctantcnttccctgnngataaatgtcaatgagannctnttcncnaaggnccangtttgnaaantttnnacgggnccg

SEQ ID NO: 2996 - DNA, 288 bp, Glycine max
  unsure (1)..(288): unsure at all n locations
cgtcgcangcacgcgtacgtaagctcggaattcggctcgagcccgaccccanctccaccgncaacgccgagtttcanatcgtgcttacnatcatcagagatgggttgangaccgatcccaccaggtaccgcaagatgncggngcgtctcgttggggttnctgaggnnaccaccactggngtnangaggctctatnagatgnaggcgaatgggnctcttctcttccctgcnattnntgtnaatgacnngtcnccangagcaagtttgacaacntgtatnggtgccgtca

SEQ ID NO: 2997 - DNA, 334 bp, Glycine max
  unsure (1)..(334): unsure at all n locations
cgtcgcngcacgcgtacgtnagctcggaattcggctcgagtcaacatcaagcctcaaacagacagatgggttttccccgataccaagagggggatcatcgtgttggcagagggtcgtttgatgaacttggggtgtgccacgggacaccccagctttgtgatgtcgtgctccttcaccaaccaggtcattgctcagcttgaattgtggaaagagaagggttctgggaagtatgagaagaaggataatnnatncccaagcacctnacgagaaagnngcntnananctaccattgccagcattgagcnntgcgnaccaagcgttccaaagaccaagc

SEQ ID NO: 2998 - DNA, 277 bp, Glycine max
  unsure (1)..(277): unsure at all n locations
gcacgcgtacgtaagctcggaattcggctcgagcggagttccagatcgtgctgagcatcatcagggatggcttgaagaccgatcccaagaggtaccacaagatgaaggacagaatcgtcggtgtctccgaagaaaccaccaccggtgtcaagaggctctaccagatgcaggccaatggctccctcttgttccctgccatcaacgtcaatgactcggtcaccaagagcaagtntgataacttgtatggatgccgtcactcgcttcccgatggactgat

SEQ ID NO: 2999 - DNA, 293 bp, Glycine max
  unsure (1)..(293): unsure at all n locations
tcgcangcacgcgtacgtaagctcgnnaattcggctcgagctcagcccttcaagggggcccgcatcaccggctcccttcacatgaccatccagaccgctgtcctcatcgagacccncancgttctnggcgncgtggttcnntngtgctcctnnaanntnttcnccattnagnnncncancgcngtcgcnatcgcncgtntcagcgtccgctgtctacgcctgtaatggtgataccctccatgagtactnttggtgcacngatgngccctcgatgggnccccggcggcngnccc

SEQ ID NO: 3000 - DNA, 288 bp, Glycine max
  unsure (1)..(288): unsure at all n locations
gcgaangcatgcacgcgtacgtaagctcggaattcggctcgaggccagcttggagctaggctcaccaagctttccaaagaccaagctgattacatcagtgtgcctgttgagggtccatacaagcctcctcactacaggtactgatccatcctattnngggagaataaacctaaactattntatcaattcccgaggcntcattgttacactttcctttttggattttttccattacaatttacntttgtggtagcatcggagcttcttttttcttttttagtannatca

SEQ ID NO: 3001 - DNA, 286 bp, Glycine max
  unsure (1)..(286): unsure at all n locations
gcangcacgcgtacgtaagctcggaattcggctcgaggtctccgaggccgacatcttcgtcaccaccacagggaacaaggacattatcatgcttgaccacatgaagaagatgaagaacaatgccatcgtgtgcaacattggccacttcgacaacgaaatcgacatgctggggcttgagacctgccctggtgtgaagcgcatcaacatcaagcctcanacngacagatgggttttccccgataccaagagggggatcatcgtgttggcagagggtcgtttgatgaan

SEQ ID NO: 3002 - DNA, 294 bp, Glycine max
  unsure (1)..(294): unsure at all n locations
acgncgcanggacncgtaagntcaggtctcnagctcgnggcnaggatcccaagaggtaccacaacgnngaaggacagaatcgtcggtgtctccgaaganaccaccaccggtgtcaagaggctctaccagatgcnggcnaatggctccctcttgttccctgccatcaacgtcaatgactcggtcaccaanagnangtttgataacttgtntggatnccgtcactcgcttcccgatggactgatgagagccactgatntgatgattgccggaaaggnagctgttgtgtgtggctac

SEQ ID NO: 3003 - DNA, 256 bp, Glycine max
  unsure (1)..(256): unsure at all n locations
gtcacacgaggtcccgatagantgatgaancgccactgatgtgatgatngccggaaaggtagcagttgnggnnggcaccgagangnggcaaggntagnncancgcnaanangnaaaccngggcncgtgtcatngtcancgagatngatcccatntntncccttnaggcnctaatgncgggtcttcaggttctcaccctggaagatgtngtctccgaggccgacatcntcgtcaccancacagggaacaaggacatt

SEQ ID NO: 3004 - DNA, 302 bp, Glycine max
  unsure (1)..(302): unsure at all n locations
gtngcanncacgcgtacgtaagctcggaattcggctcgaangggccccggcggcggccccgacctcatcgtcgacgacggaggcgacgccancctcctcatccacgagggcgtcaaggccgaggagctctatgagnagaccggggaantccncgnncctaantccactnacaacgccgagttccagattgtgcttaccatcatcagngatgggtnnaanaangatcccannaggtaccgnaanntgaaggancgtctcgttggggtttctgangaacccacgatggtgttaagatgtananc

SEQ ID NO: 3005 - DNA, 313 bp, Glycine max
  unsure (1)..(313): unsure at all n locations
aaancntcaatcgcangcacgcgtacgtnagctcggaattcggctcgagcagagatgggttgaagaccgatcccaccaggtaccgcaagatgaaggagcgtctcgttggggttnctgaggaaaccaccactggtgttaagaggctatatcagatgcagcgattgggatcctattnttccnngnaattaatgtcaatgactctgttaccaagancaatttgacaacttgtaccgggtgccgtcantctctccctgatggnctantnaggcctactnntgtgntgttgnctggaaagttgnnngtgttgcntgat

SEQ ID NO: 3006 - DNA, 306 bp, Glycine max
  unsure (1)..(306): unsure at all n locations
agtcgcatgcacncgtacgtaagctcggaattcggctcgagggnccgcatcaacggctccctccacatgacnatccagaggaggcgttntcattgagannntcanngnccttggngncgaggtncgntggtgctcntgcaanatcttctccacccaggancacgcnnacgcngctattgcccgcganagtgcngccgtcttcgnctggaagggtgagaccctccaggagtactggtggtgcaccgagcgcgcnctcgantggggccccggtggtggaccganctcatcgtcgacgaggtggtgang

SEQ ID NO: 3007 - DNA, 70 bp, Glycine max
  unsure (1)..(70): unsure at all n locations
attnttntgctttgaccacatnnagaanatgaagnannantgccttggtgttgcaacatttggccacttt

SEQ ID NO: 3008 - DNA, 536 bp, Glycine max
  unsure (1)..(536): unsure at all n locations
gggggngnnnnnnnttcannggttncctgccgtaacggtccgaaatcccgggtcgncccacgcgtccgcccacgcgtccgncggntgcganaagannacagaagggggcccaggctgattacatcantgtgcctgttgagggtccatncaagcctgctcantacnngtactaagtaattgagattatcaacggaacagtgaggganagacntantcggttttatgaatcgggntgattgtttaagttntccttttttttgaggttttgttgttanacttttcagatttgagggtagcctnagtttanctttngggcngcnnaagnagnagtcaggtnttnaaaaaaggnggcngngntggnggatcnaannttacgtacgcttgcntncaacgtcatnnctcttcgaaagtggcaccnattttcaattcaggggccggncgttttaannncnncnttnncggggaaaaccttggggntanccanggttacccccttgncntnannncccnttttccccnanttgggttaaaaaaaa

SEQ ID NO: 3009 - DNA, 330 bp, Glycine max
  unsure (1)..(330): unsure at all n locations
gtccnatncggctgngngnagacgnggggttgggtnacntggnnntcntcntggttgnccncttgaggnncttgatgancaatgccattgtttgctncattggtcactttgggcctgagatngacntgcttggnctggagnactattccggtgtgntnngcatcaccatcatgncccctttctgacagatgggtcttccctgataccngcnccggtatcnttgtcttggctgagggtcnnttgntnatcttgggatncnccattngncacttccnttttgtgatgtcctgctccttcngcantnggntcnntgctcngnttgngttgtgg

SEQ ID NO: 3010 - DNA, 473 bp, Glycine max
  unsure (1)..(473): unsure at all n locations
gtttgattccgagccanncaatgcatcgnanncangcgtacntaaactcggaattcggcncnagcaatgactctgtcaccaagagcaantttgacancttgtatgggtgccgtcactctctccctgatggnctcatgagggctaccgatgttatgattgctggaaaggtggctgttgtggctggatatggtgatgttggcaagggttgtgctgctgcaatgaagcaggctggtgctcgtgtcatcgtgaccganattgatcccatctgtgcccttcaggctctcatggaaggccttcaggttctgaccttggaggatgttgtttctgaggctgatatctttgtcaccaccaccggtaacaaggacatcatcatggttgaccacatgaggaaaatgaacaacaatgccattgtttgcaacattggtcacnttgacaatgagatcgacatgcttgggctggagaactaacccggg

SEQ ID NO: 3011 - DNA, 500 bp, Glycine max
  unsure (1)..(500): unsure at all n locations
gaggnntgntttgnancnananactttcgcctgccgtaccggtccggaattcccgggtcgacccacgcgtccgcggacgcgtgggcggacgcgtgggctgcgagagacgacagaaggggggactctactcttccctgctattaatgtcaatgactctgttaccaagagcaagtttgacaacttgtacgggtgctgtcactctctccctgatggtctgatgagggctactgatgtgatgattgctggaaaggtggctgttgtggctggatatggngatgttggcaagggttgtgctgctgcattgaagcaggctggtgctcgtgtcatcgtgactgagattgaccccatttgtgcccttcaggctctcatggaaggccttcaggttctgaccttggaggatgttgtttctgaggctgatatctttgtcaccaccacgggtaacaaggacatcatcatggntgaccacatgaagaaaatgaagaacaatgccattgtttgca

SEQ ID NO: 3012 - DNA, 383 bp, Glycine max
ccattgtttgcaacattggtcactttgacaatgagatcgacatgcttgggctggagaactaccccggcgtgaagcgcatcaccatcaagccccaaactgacagatgggtcttccctgagaccaacaccggtatcattgtcttggctgagggtcgattgatgaacttgggatgcgccactggacaccccagttttgtgatgtcctgctccttcaccaaccaggtcattgctcagcttgagttgtggaaggagaagagtaccggcaagtacgagaagaaggtttacgttttgcccaagcaccttgatgagaaggtggctgcacttcacctgggcaaacttggagctaagctgacccagcttagcaagtcccaggctgattacatc

SEQ ID NO: 3013 - DNA, 528 bp, Glycine max
  unsure (1)..(528): unsure at all n locations
gnnnggaggtttganngggggngggnnnnnnnnnnnnnnnnnnnnnnnnnnnnnnnnnnnnnnnnnnnnnnnnnnnnnnnnnnnnnnnnnnnagagaganagagagagatctatctatctatcaagatggngttgttggttgagaaaacaagcagtggaagggagtacaaggtgaaggacatgacgcaagccgatttcggaagattggaaatcgagctggcggaggttgaaatgcccggcctcatgtcctcccgcaccgagttcggcccctctcaacccttcaagggcgctaggatcaccggctccctccacatgaccatccaaaccgccgtcctcatcgagaccctcaccgccctcggcgccgaggtccgctggtgctcctgcaacatcttctccacccaggaccatgccgccgccgccatngcccgcgacagcgccttcgtcttcgcctggaaggggtgagaccctncaggaatactggtggtgcaccgagcgcgccctcgactggggccccggcggngggcccca

SEQ ID NO: 3014 - DNA, 520 bp, Glycine max
  unsure (1)..(520): unsure at all n locations
agngtttttgtanntggggggggggggggnaagnganatatnttagctatagatntnacatgtacanngtacgtaagctcggaattcggctcgagggccgacttcggccgcctcgagatcgagctggcccgaggttgagatgccgggcctcatggcctggcggaccgagttcggcccatctcacccttcaagggggcccgcatcaccggctcccttcacatgaccatncagaccgctgtcctcatcgagaccctcaccgntctcggcgccgaggttcgctggtgctcctgcaacatcttctcactcaggaccacgccgccgncgccatcgcccgtgacagcgccgncgtcttcgcctggaagggtgagaccctccaggagtactggtggtgcaccgagcgcgcccttgactggggccccggcggcggccccgacctnattgtcgacgacngaagcnacgccacctctnatcacgaaggcctnaangnccagggctctatnannaagaccggggaactccc

SEQ ID NO: 3015 - DNA, 344 bp, Glycine max
  unsure (1)..(344): unsure at all n locations
gttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcgnaccgagttcggcccntcccagccttcaagggggcccgcatcaccggctccctccacatgaccatccagcggcgccgttctcattgagaccctcaccgcccttggcgccgaggtccgctggtgctcctgcaacatcttctccanccaggaccacgccgccgccgtanttcncgcgacagtgcngccgtcttcgc

SEQ ID NO: 3016 - DNA, 528 bp, Glycine max
  unsure (1)..(528): unsure at all n locations
ggnnnaagtttttgnnggggggggnannangtnnnnnnnnnnnnnnnnnnnnnnnnnnnnnnnnnnnnnnnnnnnnnnnnnnnnnnnnnnnnnnnnnnnnnnntcgagatcganctggcccgaggtngagatggcgatcctcatggcgtggcggaccgagttcggcccatctcancccttgaagggggcccgcatnaccggctccnttcacatgaccattcanaccgntgtcctcatcganaccctnaccgctctcggcgccgaggttcgctggtgctcctgcaacatcttctccactcaggaccacgccgncgncgccatcgcccgtgacagcgccgncgtcttcgcctggaagggtgagaccctncangagtactggtggtncaccgagcgcgcccttgactggggcccccgcgnggccccgaccttatngtcnaccgaccgaaggcaaccccaccttcttatcaacnaggccgtnaaggccaaggagctctatnaagaagaccggggaactccccnaccctaact

SEQ ID NO: 3017 - DNA, 347 bp, Glycine max
  unsure (1)..(347): unsure at all n locations
ccggctcccttcacatgaccatccagaccgctgtcctcatcgagaccctncaccgctctcggcgccgaggttcgctggtgctcctgcaacatcttctccactcaggaccannnnnnnnnnnnnnnnnnncgtgacagcgccgccgtcttcgcctggaagggtgagaccctccaggagtactggtggtgcaccgagcgcgccctcgactggggccccggcggcggccccgacctncatcgtcgacgacggaggcgacgccaccctcctcatccacganggcgtcaaggccgaggagctctatgagaagaccggggaattccccgaccctaattccantgacaacgcgg

SEQ ID NO: 3018 - DNA, 332 bp, Glycine max
  unsure (1)..(332): unsure at all n locations
gtcgcangcacgcntacgtnagctcggaattcggctcgagcaggttctgaccttggaggatgttgtttctgaggctgatatctttgtcaccaccaccggtaacaaggacatcatcatggttgaccacatgaggaaaatgaagaacaatgccattgtttgcaacattggtcactttgacaatgagatcgacatgcttgggctggagaactaccccggcgtgaagcgcatcaccatcaagccccaaactgacagatgggtcttccctgagaccaacaccggtatcattgtcttggctgagggtcgattgatgaacttgggatgcgccactggac

SEQ ID NO: 3019 - DNA, 307 bp, Glycine max
  unsure (1)..(307): unsure at all n locations
ngtngangcacgcgtacgtaagctcggaattcggctcgaggtcaaggacctntcccaggccgacttcggccgcctcgagatcgagctggccgaggttgagatgcccggcctcatggcctgtcggacngagttcggcccctcccagcccttcaagggggcccgcatcaccggctccctccacatgaccatccagngcgccgttctcattgagaccctcaccgcccttggcgccgaggtccgctggtgctcctgcaacatcttctccacccaggaccacgccgccgccgctattgcccgcgacagtgcc

SEQ ID NO: 3020 - DNA, 298 bp, Glycine max
  unsure (1)..(298): unsure at all n locations
cgctgcntacgtacgtaagctcggaattcggctcgagccgagttcggcccctcccagcccttcaagggggcccgcatcaccggctccctccacatgaccatccagaccgccgttctcattgagaccctcaccgcccttggcgccgaggtccgctggtgctcctgcaacatcttctccacccaggaccacgccgccgccgctattgcccgcgacagtgccgccgtcttcgcctggaagggtgagaccctccaggagtactggtggtgcaccgagcgcgccctcgactggggccccggtg

SEQ ID NO: 3021 - DNA, 339 bp, Glycine max
  unsure (1)..(339): unsure at all n locations
ctttctctagtcctgttatttctcagcgcgtaaagcatggctttgttggtggagaaaaccacgagtggtcgcgantacaaggtcaaggactttcccaggccgacttcggccgcctcgagatcgagctggccgaggttganatgcccggcctcatggcctgtcggaccgagttcggcccctcccagcccttcaagggggcncgcatcaccggntccctccacatnaccatccagaccgccgttctcattgagaccctcaccgcccttggcgccgaggtncgctggtgctcctgcaacatcttctccacccaggaccacgccgngccgctattgtcgcgaa

SEQ ID NO: 3022 - DNA, 275 bp, Glycine max
caccactggtgttaagaggctatatcagatgcaggcgaatgggactctactcttccctgctattaatgtcaatgactctgttaccaagagcaagtttgacaacttgtacgggtgccgtcactctctccctgatggtctgatgagggctactgatgtgatgattgctggaaaggtggctgttgtggctggatatggtgatgttggcaagggttgtgctgctgcattgaagcaggctggtgctcgtgtcatcgtgactgagattgaccccatttgtg

SEQ ID NO: 3023 - DNA, 320 bp, Glycine max
  unsure (1)..(320): unsure at all n locations
cnntncacgcgtacgtnagctcggaattcggctcgaggaggaaaccaccactggtgttaagaggctatatcagatgcaggcgaatgggactctactcttccctgctattaatgtcaatgactctgttaccaagancaagtttgacaacttgtacgggtgccgtcactctctccctgatggtctgatgagggctactgatgtgatgattgctggaaaggtggctgttgtggctggatatggtgatgttggcaagggttgtgctgctgcattgaagcaggctggtgctcgtgtcatcgtgactgagattgaccccattgtgc

SEQ ID NO: 3024 - DNA, 306 bp, Glycine max
  unsure (1)..(306): unsure at all n locations
atgtcgcgttcacgcgtacgtaagctcggaattcggctcgagggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagancgccgttctcattgagaccctcaccgcccttggcgccgaggtccgctggtgctcctgcaacatcttctccaccca

SEQ ID NO: 3025 - DNA, 518 bp, Glycine max
  unsure (1)..(518): unsure at all n locations
agtttntnttnngggggggggggggnaangagtancgctnagctatgacgtcgcatgcacgcgtacgtaagctcggaattcggctcgaggagagatctatctatctatcaagatggcgttgttggttgagaaaacaagcagtggaagggagtacaaggtgaaggacatgacgcaagccgatttcggaagattggaaatcgagctggcggaggttgaaatgcccggcctcatgtcctcccgcaccgagttcggcccctctcaacccttcaagggcgctaggatcaccggctccctncacatgaccatncaaaccgncgtcctcatcgagaccctnaccggcctnggcgccgaggtcccgctggtgctnctgcaacatcttcttcanccaagaccatgccggcgcgcatcgccgggacagcgccttcgtcttcgcctggaaaggtgagacccttcaggaatctggtggtgcaccgagcgcgcccttgactggggccccngcggcggcccgatctnattgt

SEQ ID NO: 3026 - DNA, 338 bp, Glycine max
  unsure (1)..(338): unsure at all n locations
ctccaaggtcagaacctgaaggccttccatgagagcctgatatctttgtcaccaccaccggtaacaaggacatcatcatggttgaccacatgaggaaaatgaagaacaatgccattgtttgcaacattggtcactttgacaatgagatcgacatgcttgggctggagaactaccccggcgtgaagcgcatcaccatcaagccccaaactgacagatgggtctnccctgagaccaacaccggtatcattgtcttggctgagggtcgattgatgacttgggatgcgccatggacaccccagttttgtgatgtcctgctccttcaccaacangtcattgtc

SEQ ID NO: 3027 - DNA, 286 bp, Glycine max
gtaccaatgtcggcatcattgtcttggccgagggtcgtttgatgaacttgggatgcgccacaggacaccctagttttgtgatgtcctgctccttcaccaaccaggtcattgctcagcttgagttgtggaaggagaagagtaccggcaagtacgagaagaaagtttacgttttgcccaagcaccttgatgacaaggtggctgcacttcaccttggcaaacttggagctaagctcaccaagcttagcccggcccaggctgattacatcagtgtgcctgttgagggtcc

SEQ ID NO: 3028 - DNA, 340 bp, Glycine max
  unsure (1)..(340): unsure at all n locations
gtcgcatgcacgcgtacgtaagctcggaattcggctcgagncgatgttatgattgctggaaaggtggctgttgtggctggatatggtgatgttggcaagggttgtgctgctgcaatgaagcaggctggcgctcgtgtcatcgtgaccgagantcnatcccatctgtgcccttcaggctctcatgnaaggccttcaggttctgaccttggaggatgttgtttctgaggctgatatctttgtcaccaccaccggtaacaaggacatcatcatggttgaccacatgaggaaaatgaagaacaatgccattgtttgcaacattggtcactttgacaatgagatc

SEQ ID NO: 3029 - DNA, 312 bp, Glycine max
tcgcatgcacgcgtacgtaagctcggaattcggctcgagctgaggaaaccaccactggagttaagaggctctatcagatgcaggcgaatgggactcttctcttccctgctattaatgtcaatgactctgtcaccaagagcaagtttgacaacttgtatgggtgccgtcactctctccctgatggtctcatgagggctaccgatgttatgattgctggaaaggtggctgttgtggctggatatggtgatgttggcaagggttgtgctgctgcaatgaagcaggctggtgctcgtgtcatcgtgaccgagattg

SEQ ID NO: 3030 - DNA, 280 bp, Glycine max
  unsure (1)..(280): unsure at all n locations
agtcgcangcacgcgtacgtaagctcggaattcggctcgagaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagaccgccgttctcattgagaccctcaccgcccttggcgccgaggtccgctggtgctcctgcaacatcttctccacccaggacca

SEQ ID NO: 3031 - DNA, 324 bp, Glycine max
  unsure (1)..(324): unsure at all n locations
ngangcacgcgtacgtaagtcggaattcggctcgagtgttatttctcagcgcgtaaagcatgggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcncctcccagcccttcaagggggcccgcatcaccggctccctccacatgaccatccagaccgccgttctcattgagaccctcaccgcccttggcgccgagntccgctggtgctcctgcaacatc

SEQ ID NO: 3032 - DNA, 303 bp, Glycine max
  unsure (1)..(303): unsure at all n locations
acgtcgcangcacgcgtacgtnagctcggaattcggctcgaggcccctcccagcccttcaagggggcccgcatcaccggctccctccacatgaccatccaganccgccgttctcattgagaccctcaccgcccttggcgccgaggtccgctggtgctcctgcaacatcttctccacccaggaccacgccgccgccgctattgcccgcgacagtgccgccgtcttcgcctggaagggtgagaccctccaggagtactggtggtgcaccgagcgcgccctcgactggggccccggtggtggaccc

SEQ ID NO: 3033 - DNA, 308 bp, Glycine max
  unsure (1)..(308): unsure at all n locations
gtnnatncacgcgtacgtaagctcggaattcggctcgaggctggtgctcctgcaacatcttctccacccaggaccacgccgccgccgctattgcccgcgacagtgccgccgtcttcgcctggaagggtgagaccctccaggagtactggtggtgcaccgagcgcgccctcgactggggccccggtggtggacccgacctcatcgtcgacgacggtggtgacgctacccttctcatccacgaaggcgtcaaggccgaggagctctatgagaagaccggcgaactccccgaccccaactccaccgacaac

SEQ ID NO: 3034 - DNA, 294 bp, Glycine max
  unsure (1)..(294): unsure at all n locations
gtcgcangcacgcgtacgtaagctcggaattcggctcgagcaccggtaacaaggacatcatcatggttgaccacatgaggaaaatgaagaacaatgccattgtttgcaacattggtcactttgacaatgagatcgacatgcttgggctggagaactaccccggcgtgaagcgcatcaccatcaagccccaaactgacagatgggtcttccctgagaccaacaccggtatcattgtcttggctgagggtcgattgatgaacttgggatgcgccactggacaccccagttttgtga

SEQ ID NO: 3035 - DNA, 332 bp, Glycine max
  unsure (1)..(332): unsure at all n locations
ntacagtcgcangcacgcgtacgtnagctcggaattcggctcgagctctatcagatgcaggcgaatgggactcttctcttccctgctantaatgtcaatgactctgtcaccaagancaagtttgacaacttgtatgggtgccgtcactctctccctgatggtctcatgagggctaccgatgttatgattgctggaaaggtggctgttgtggctggatatggtgatgttggcaagggttgtgctgctgcaatgaagcaggctggtgctcgtgtcatcgtgaccgagattgatcccatctgtgcccttcaggctctcatggaagccttcaggtt

SEQ ID NO: 3036 - DNA, 287 bp, Glycine max
  unsure (1)..(287): unsure at all n locations
tcncatcgcatgcacgcgtacgtaagctcggaattcggctcgagcgagtacaaggtcaaggacctttcccaggccgacttcggccgcctcgagatcgagctggccgaggttgagatgcncggcctcatggnctgtcggacngagttcggcncctcccagcccttcaagggggcccgcatcaccggctccctccacatgaccatccagancgccgttctcattgagaccctcaccgcccttggcgccgaggtccgctggtgctcctgcaacatcttctccacccagga

SEQ ID NO: 3037 - DNA, 326 bp, Glycine max
gcacgcgtacgtaagctcggaattcggctcgaggttccagatcgtgcttaccatcatcagagatgggttgaagaccgatcccaccaggtaccgcaagatgaaggagcgtctcgttggggtttctgaggaaaccaccactggtgttaagaggctatatcagatgcaggcgaatgggactctactcttcctgctattaatgtcaatgactctgttaccaagagcaagtttgacaacttgtacgggtgccgtcactctctccctgatggtctgatgagggctactgatgtgatgattgctggaaaggtggctgttgtggctggatatgg

SEQ ID NO: 3038 - DNA, 306 bp, Glycine max
  unsure (1)..(306): unsure at all n locations
cgcangcacgcgtacgtaagctcggaattcggctcgagggaaaatgaagaacaatgccattgtttgcaacattggtcactttgacaatgagatcgacatgcttgggctggagaactaccccggcgtgaagcgcatcaccatcaagccccaaactgacagatgggtcttccctgagaccaacaccggtatcattgtcttggctgagggtcgattgatgaacttgggatgcgccactggacaccccagtttgtgatgtcctgctccttcaccaaccaggtcattgctcagcttgagttgtggaaggag

SEQ ID NO: 3039 - DNA, 259 bp, Glycine max
  unsure (1)..(259): unsure at all n locations
ctcattgagaccctcaccgcccttggcgccgaggtccgctggtgctcctgcaacatcttctccacccaggaccacgccnccgccgctattgcccgcgacagtgccgccgtcttcgcctggaagggtgagaccctccaggagtactggtggtgcaccgagcgcgccctcgactggggccccggtggtggacccgacctcatcgtcgacgacggtggtgacgctacccttctcatccacgaagcgtcaaggccgaggagct

SEQ ID NO: 3040 - DNA, 306 bp, Glycine max
  unsure (1)..(306): unsure at all n locations
nncgcatgcacgcntacgtaaagctcggaattcggctcgaggtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagancgccgttctcattgagaccctcaccgcccttggcgccgaggtccgctggtgtcctgca

SEQ ID NO: 3041 - DNA, 312 bp, Glycine max
  unsure (1)..(312): unsure at all n locations
ttcangcncgcntacgtaagctcggaattcggctcganncttgggatgcgccactggacaccccagtnttgtnatgtcctgctccttcaccaaccaggtcattgctcagcttgagttgtggaaggagaagagtaccggcaagtacgagaagaaggtttacgttttgcccaagcaccttgatgagaaggtggctgcacttcacctgggcaaacttggngctaagctgacccagcttngcaagtcccaggctgattacatcagtgtgcctgttganggtccatacaagcctgctcactacaggtactaagtgat

SEQ ID NO: 3042 - DNA, 330 bp, Glycine max
  unsure (1)..(330): unsure at all n locations
cnaagtctcnngcacgcgtacgtaantcggaattcggctcgaggctggtgctcctgcaacatcttctccacccaggaccacgccgccgccgctattgcccgcggacagttnccgccgncttcgcctggaagggtgagaccctccaggagtactggtggtgcaccgagcgcgccctcgactggggccccggtggtggacccgacctcatcgtcgacgacggtggtgacgctacccttctcatccacgaaggcgtcaaggccgaggagctctatgagaagaccggcgaactccccgaccccaactccaccgacaacgccgagtttcagatct

SEQ ID NO: 3043 - DNA, 314 bp, Glycine max
  unsure (1)..(314): unsure at all n locations
gtcgtatgcacgcgtangtaagctcngaattcggctcgagtttctgaggaaaccaccactggagttaagaggctctatcagatgcaggcgaatgggactcttctcttccctgctattaatgtcaatgactctgtcaccaagagcaagtttgacaacttgtatgggtgccgtcactctctccctgatggtctcatgagggctaccgatgttatgattgctggaaaggtggctgttgtggctggatatggtgatgttggcaaggttgtgctgctgcaatgaagcaggctggtgctcgtgtcatcgtgancgagatc

SEQ ID NO: 3044 - DNA, 312 bp, Glycine max
  unsure (1)..(312): unsure at all n locations
naccanncncgcgtacgtaagctcggaattcggctcgagtgggactcttctcttccctgctattaatgtcaatgactctgtcaccaagagcaagtttgacaacttgtatgggtgccgtcactctctccctgatggtctcatgagggctaccgatgttatgattgctggaaaggtggctgttgtggctggatatggtgatgttggcaagggttgtgctgctgcaatgaagcaggctggtgctcgtgtcatcgtgaccgagattgatcccatctgtgcccttcaggctctcatggaaggcctcaggttctgacc

SEQ ID NO: 3045 - DNA, 307 bp, Glycine max
  unsure (1)..(307): unsure at all n locations
gtcgcangcacgcntacgtnanctcggnnttnggctcgagcnagggttgtnctgccgcantgaagcaggctggtgctcgtgtcatcgtgaccgagattgatcccatctgtgcccttcaggctctcatggnaggccttcaggntctgaccttggaggatgttgtttctgangctgatatctttgtcaccaccaccggtaacaaggacatcatcatggttgaccacatgaggaaaatgaagaacaatgccattgtttgcnacattggtcactntgacaatgagatcgacatgcttgggctggagaacta

SEQ ID NO: 3046 - DNA, 314 bp, Glycine max
  unsure (1)..(314): unsure at all n locations
tccgtgcacgcgtacgtaagctcggaattcggctcgagntggatgcgccactggacaccccagttttgtgatgtcctgctccttcaccaaccaggtcattgctcagcttgagttgtggaaggagaagagtaccggcaagtacgagaagaaggtttacgttttgcccaagcaccttgatgagaaggtggctgcacttcacctgggcaaacttggngctaagctgacccagcttagcaagtcccaggctgattacatcagtgtgcctgttgagggtccatacaagcctgctcactacaggtactaagtgattgaga

SEQ ID NO: 3047 - DNA, 316 bp, Glycine max
  unsure (1)..(316): unsure at all n locations
cntacgtaagctcggaattcggctcgaggtcctgttatttctcagcgcgtaaagcatggctttgttggtggagaaaaccacgagtggtcgcgagtacaaggtcaaggacctttcccaggccgacttcggccgcctcgagatcgagctngccgaggttgagatgcccggcctcatggcctgtcggaccgagttcggcccctcccagcccttcaagggggcccgcatcaccggctcctccacatgaccatccagaccgccgttctcattgagaccctcaccgcccttggcgccgaggtccgctggtgctctgcaacat

SEQ ID NO: 3048 - DNA, 259 bp, Glycine max
  unsure (1)..(259): unsure at all n locations
gttgtttctgaggctgatatctttgtcaccaccaccggtaacaagggacatcatcatggttgaccacatgaggaaaatgaagaacaatgccattgtttgcaacattggtcactttgacaatgagatcgacatgcttgggctggagaactaccccggcgtgangcgcatcaccatcaagccccaaactgacagatgggtcttccctgagaccaacaccggtatcattgtcttggctgagggtcgattgatgaacttggga

SEQ ID NO: 3049 - DNA, 346 bp, Glycine max
  unsure (1)..(346): unsure at all n locations
agaacgnnaanangtcgcatgcacgcgtacgtaagctcgggaattcggctcgagcagtgccgccgtcttcncctggaagggtgagaccctccaggagtactggtggtgcaccgagcgcgccctcgactgangccccggtggtggacccgacctcatcgtcgacgacggtggtgacgctacccttctcatccacgaaggcgtcaaggccgaggagctctatgagaagaccggcgaactccccgacccnaactccaccgacaacgccgagtttcagatcgtgcttaccatcatcagagatgggttgaagaccgatcccaccaggtaccgcaaagtgaaggagcgtctc

SEQ ID NO: 3050 - DNA, 319 bp, Glycine max
  unsure (1)..(319): unsure at all n locations
gangcacncgtacgtnagctcggaattcggctcgagctctttctctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagaccgccgttctcattgagaccctcaccgcccttggcgccgaggtccg

SEQ ID NO: 3051 - DNA, 298 bp, Glycine max
  unsure (1)..(298): unsure at all n locations
ntacgcangcacncgtacgtnagctcggaattcggctcgaggtaaagcatggctttgttggtggagaaaaccacgagtggtcgcnagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagaccgccgttctcattgagaccctcaccgcncttggcgccgangtccgctggt

SEQ ID NO: 3052 - DNA, 317 bp, Glycine max
  unsure (1)..(317): unsure at all n locations
tcgcangcacgcgtacgtaagctcggaattcggctcgagctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtncggaccgagttcggcccctcccagcccttcaagggggcccgcatcaccggctccctccacatgaccatccagaccgccgttctcattgagaccctcaccgcccttggcgccgaggtccgctggtgct

SEQ ID NO: 3053 - DNA, 311 bp, Glycine max
gtcgcatgcacgcgtacgtaagctcggaattcggctcgaggcaagatgaaggagcgtctcgttggggtttctgaggaaaccaccactggagttaagaggctctatacagatgcaggcgaatgggactcttctcttccctgctattaatgtcaatgactctgtcaccaagagcaagtttgacaacttgtatgggtgccgtcactctctccctgatggtctcatgagggctaccgatgttatgattgctggaaaggtggctgttgtggctggatatggtgatgttggcaagggttgtgctgctgcaatgaagc

SEQ ID NO: 3054 - DNA, 308 bp, Glycine max
  unsure (1)..(308): unsure at all n locations
nncangcncgcgtacgtnagctcggaattccgctcgagctcgagccgcgggtaacaaggacatcatcatggttgaccacatgangaaaatgaagaacaancgccattgtttgcaacattggtcactttgacaatgagatcgacatgctggggctggagaactaccccggcgtgaagcgcatcaccatcaagccccaaaccgacagatgggtcttccccgagaccaatgtcggcatcattgtcttggccgagggtcgtttgatgaacttgggatgcgccacaggacaccctagttttgtgatgtcctgc

SEQ ID NO: 3055 - DNA, 347 bp, Glycine max
  unsure (1)..(347): unsure at all n locations
cntnnnnatgnanacgtcgcatgcacgcgtacgtnaagctcggaattcggctcgagctctttctctagtcctgttatttctcagcgcgtaaagcatggctntgttggtggagaaaaccacgagtggtcgcgagtacaaggtcaaggacctttcccaggccgacttcggccgcctcgagatcgagctggccgaggttgagatgcccggcctcatggnctgtnggaccgagttcggcccctcccancccttcaagggggcccgcatcaccggctccctccacatgaccatccagancgccgttctcattgagaccctcaacggccttggcgccgangtccgctggtgct

SEQ ID NO: 3056 - DNA, 349 bp, Glycine max
  unsure (1)..(349): unsure at all n locations
cgcgtacgtaagctcggaattcggctcgagngacgacggtggtgacgctacccttctcatccacgaaggcgtcaaggccgaggagctctatgagaagaccggcgaactccccgaccccaactccaccgacaacgccgagtttcagatcgtgcttaccatcatcagagatgggttgaagaccgatcccaccaggtaccgcaagatgaaggagcgtctcgttggggtttctgaggaaaccaccactggagttaagaggctctatcagatgcaggcgaatgggactcttctcttccctgctattaatgtcaatgactctgtcaccaagagcgagttgacaattgtatgggtg

SEQ ID NO: 3057 - DNA, 315 bp, Glycine max
  unsure (1)..(315): unsure at all n locations
tcgcangcacgcgtacgtaagctcggaattcggctcgagnagtcctgttatttctcagcgcgtaaagcatggctttgttggtggagaaaaccacgagtggtcgcgagtacaaggtcaaggacctttcccaggctgacttcggccgcctcgagatcgagctggccgaggtcgagatgcccggcctcatggcctgtcggaccgagttcggcccctcccagcccttcaagggggcccgcatcaccggctccctccacatgaccatccagaccgccgttctcattgagaccctcaccgcccttggcgcnnaggtccgct

SEQ ID NO: 3058 - DNA, 339 bp, Glycine max
  unsure (1)..(339): unsure at all n locations
cnatntttgnacgcgtacgtaagctcggaattcggctcgacctcgagccgattcggctcgaggttatttctcagcgcgtaaagcaacggctttgttggtggananaaccacgagtggtcgcnngtacaaggtcaaggacctttcccaggccgacttcggccgcctcgagatcgagctggccgaggttgagatgcccggcctcatggcctgtcggaccgagttcggcccctcccancccttcaagggggcccgcatcaccggctccctccacatgaccatccagaccgccgttctcattgagaccctcaccgcccttggcgccgaggtccgctggtgctc

SEQ ID NO: 3059 - DNA, 301 bp, Glycine max
  unsure (1)..(301): unsure at all n locations
tcgcangcacgcgtacgtaagctcggaattcggctcgaggaaaatgaagaacaatgccattgtttgcaacattggtcactttgacaatgagatcgacatgctggggctggagaactaccccggcgtgangcgcatcaccatcaagccccaaaccgacagatgggtcttccccgagaccaatgtcggcatcattgtcttggccgagggtcgtttgatgaacttgggatgcgccacaggacaccctagttttgtgatgtcctgctctcaccaaccaggtcattgctcagcttgagttgtggaa

SEQ ID NO: 3060 - DNA, 331 bp, Glycine max
tcgcatgcacgcgtacgtaagctcggaattcggctcgagctctttctctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagaccgccgttctcattgagaccctcaccgcccttggcgccgagtccgtatgtcctgc

SEQ ID NO: 3061 - DNA, 294 bp, Glycine max
  unsure (1)..(294): unsure at all n locations
tcgcangcacgcgtacgtaagctcggaattcggctcgagttgacaacttgtacgggtgccgtcactctctccctgatngtctgatgagggctactgatgtgatgattgctggaaaggtggctgttgtggctggatatggtgatgttggcaagggttgtgctgctgcattgaagcaggctggtgctcgtgtcatcgtgactgagattgaccccatttgtgcccttcaggctctcatggaaggccttcaggttctgaccttggaggatgttgtttctgaggctgatatcttgtcac

SEQ ID NO: 3062 - DNA, 291 bp, Glycine max
cacgcgtacgtaagctcggaattcggctcgaggcaggcgaatgggactcttctcttccctgctattaatgtcaatgactctgtcaccaagagcaagtttgacaacttgtatgggtgccgtcactctctccctgatggtctcatgagggctaccgatgttatgattgctggaaaggtggctgttgtggctggatatggtgatgttggcaagggttgtgctgctgcaatgaagcaggctggtgctcgtgtcatcgtgaccgagattgatcccatctgtgcccttcaggctctc

SEQ ID NO: 3063 - DNA, 293 bp, Glycine max
  unsure (1)..(293): unsure at all n locations
gtcgcangcacgcgtacgtaagctcggaattcggctcgaggaggaaaccaccactggagttaagaggctctatcagatgcaggcgaatgggactcttctcttccctgctattaatgtcaatgactctgtcaccaagagcaagtttgacaacttgtatgggtgccgtcactctctccctgatggtctcatgagggctaccgatgttatgattgctggaaaggtggctgttgtggctggatatggtgatgttggcaagggttgtgctgctgcaatgaagcaggctggtgctcgtg

SEQ ID NO: 3064 - DNA, 313 bp, Glycine max
  unsure (1)..(313): unsure at all n locations
ctnncangncnccgtacgtaagctcggaattcggctcgagngaaaatgaagaacaatgccattgtttgcaacattggtcactttgacaatgagatcgacatgcttgggctggagaactaccccggcgtgaagcgcatcaccatcaagccccaaactgacagatgggtcttccctgagacaacaccggtatcattgtcttggctgagggtcgattgatgaacttgggatgcgccactggacaccccagttttgtgatgtcctgctccttcaccaaccaggcatgctcagcttgagttgtggaaggagaagagta

SEQ ID NO: 3065 - DNA, 301 bp, Glycine max
  unsure (1)..(301): unsure at all n locations
gtcgcatgcacgcgtacgtnagctcggaattcggctcgagggaaaatgaagaacaatgccattgtttgcaacattggtcactttgacaatgagatcgacatgcttgggctggagaactaccccggcgtgaagcgcatcaccatcaagccccaaactgacagatgggtcttccctgagaccaacaccggtatcattgtcttggctgagggtcgattgatgaacttgggatgcgccactggacaccccagttttgtgatgtcctgctccttcaccaaccaggtcatgctcagcttgagttgtg

SEQ ID NO: 3066 - DNA, 325 bp, Glycine max
  unsure (1)..(325): unsure at all n locations
agtcgcnngcacgcgtacgtaagctcggaattcggctcgaggttatttctcagcgcgtaaagcatggctttgttggtggagaaaaccacgagtggtcgcgagtacaaggtcaaggacctttncccaggccgacttcggccgcctcgagatcgagctggccgaggttgagatgcccggcctcatggcctgtcggccgagttcggcccctcccagcccttcaagggggcccgcatcaccggctccctccacatgaccatccagaccgccgttctcattgagaccctcaccgcccttggcgccgaggtccgctggtgctctgcaacat

SEQ ID NO: 3067 - DNA, 296 bp, Glycine max
  unsure (1)..(296): unsure at all n locations
cgcngcacgcgtacgtaagctcggaattcggctcgagaccgatcccaccaggtaccgcaagatgaaggagcgtctcgttggggtttctgaggaaaccaccactggtgttaagaggctatatcagatgcaggcgaatgggactctactcttccctgctattaatgtcaatgactctgttaccaagagcaagtttgacaacttgtacgggtgccgtcactctctccctgatggtctgatgagggctactgatgtgatgattgctggaaangtggctgttgtggctggatatggtgaan

SEQ ID NO: 3068 - DNA, 304 bp, Glycine max
  unsure (1)..(304): unsure at all n locations
cgtagtaacgtangaantcngntcggctcnaantnntttctcagcgcgtaaagcatggctttgttggtgganataaccacgagtggtcgcgagtacaaggtcaaggacctttcccangccgacttcggccgcctcgagatcgagctggccgangttganatgcccggcctcatggcctgtcggaccgagttcggcccctcccagcccttcaagggggcccgcatcaccggctccctccacatgaccatccagaccgccgttntcattgagaccctcaccgcccttngngccgaggnccgctggt

SEQ ID NO: 3069 - DNA, 314 bp, Glycine max
  unsure (1)..(314): unsure at all n locations
cgcangcacgcgtacgtaagctcggaattcggctcgaggccgtcttcncctggaagggtgagaccctccaggagtactggtggtgcaccgagcgcgccctcgactggggccccggtggtggacccgacctcatcgtcgaacgacggtggtgacgctacccttctcatccacgaaggcgtcaaggccgaggagctctatgagaagaccggcgaactccccgaccccaactccaccgacaacgccgagtttcagatcgtgcttaccatcatcagagatgggttgaagaccgatcccaccaggtaccgcaagatgaa

SEQ ID NO: 3070 - DNA, 299 bp, Glycine max
  unsure (1)..(299): unsure at all n locations
gtcgcangcacgcgtacgtaagctcggaattcggctcgagagaaaatgaagaacaatgccattgtttgcaacattggtcactttgacaatgagatcgacatgctggggctggagaactaccccggcgtgangcgcatgcaccatcaagccccaaaccgacagatgggtcttccccgagaccaatgtcggcatcattgtcttggccgagggtcgtttgatgaacttgggatgcgccacaggacaccctagttttgtgatgtcctgctccttcaccaaccaggtcattgctcagcttgagt

SEQ ID NO: 3071 - DNA, 302 bp, Glycine max
  unsure (1)..(302): unsure at all n locations
aacgcangcacgcgtacgtaagctcngaattcggctcgaggtttganaacttgtacgggngccgtcactctctccctgatggnctgatgagggctactgtngtgatgattgctggaaaggtggctgttgtggctggatatggtgatgttggcaanggttgtgctgctgcattgaagcaggctggtgctcgtgtcatcgtgactgagattgaccccatttgtgcccttcaggctctcatggaaggccttcaggttctaccttggaggatgttgtttctgaggctgatatctttgtcaccacca

SEQ ID NO: 3072 - DNA, 289 bp, Glycine max
  unsure (1)..(289): unsure at all n locations
gtcgcangcacgcgtacgtaagctcggaattcggctcgaggggtcttccccgagaccaatgtcggcatcattgtcttggccgagggtcgtttgatgaacttgggatgcnccacaggacaccctagttttgtgatgtcctgccccttcaccaaccaggtcattgctcagcttgagttgtggaaggagaagagtaccggcaagtacgagaagaaagtttacgttttgcccaagcaccttgatgagaaggtggctgcncttcaccttggcaaacttggngctaagctcacca

SEQ ID NO: 3073 - DNA, 286 bp, Glycine max
  unsure (1)..(286): unsure at all n locations
gtcgcatgcacgcgtacgtaagctcggaattcggctcgaggtttgacaacttgtacgggtgccgtcactctctccctgatggtctgatgagggctactgatgtgatgattgctggaaaggtggctgttgtggctggatatggtgatgttggcaagggttgtgctgcnccattgaagcnggctggtgctcgtgtcatcgtgactgagattgaccccatttgtgcccttcaggctctcntggaaggccttcaggttctgaccttggaggatgttgtttctgaggctga

SEQ ID NO: 3074 - DNA, 285 bp, Glycine max
  unsure (1)..(285): unsure at all n locations
gtcgcangcacgcgtacgtaagctcggaattcggctcgaggtaagatgaaggagcgtctcgttggggtttctgaggaaaccaccactggagttaagaggctctatcagatgcaggcgaatgggactcttctcttccctgctattaatgtcaatgactctgtcaccaagagcaagtttgacaacttgtatgggtgccgtcactctctccctgatggtctcatgagggctaccgatgttatgattgctggaaaggtggctgttgtggctggatatggtgatgttggc

SEQ ID NO: 3075 - DNA, 300 bp, Glycine max
  unsure (1)..(300): unsure at all n locations
gtcncngcacgcgtacgtnagctcggaattcggctcgaggncacgggtaacaaggacatcatcatggttgaccacatgaagaaaatgaagaacaatgccattgtttgcaacattggtcactttgacaatgagatcgacatgctggggctggagaactaccccggcgtgangcgcattcaccatcaagccccaaaccgacagatgggtcttccccgagaccaatgtcggcatcattgtctgggccgagggtcgtttgatgaantgggatgcgccacaggacaccctagttttgtgatgtcc

SEQ ID NO: 3076 - DNA, 264 bp, Glycine max
  unsure (1)..(264): unsure at all n locations
ccgaggtccgctggtgctcctgcaacatcttctccacccaggaccacgccgccgccgctattgcccgcnacagtgccgccgtcttcncctggaagggtgagaccctccaggagtactggtggtgcaccgagcgcgccctgcgactggggccccggtggtggacccgacctcatcgtcgannacggtggtgacgctacccttctcatccaggaaggcgtcaaggccgaggagctctatgagaagaccggcgaactccccgancct

SEQ ID NO: 3077 - DNA, 310 bp, Glycine max
  unsure (1)..(310): unsure at all n locations
ngcangcacgcgtacgtaanctcggaattcggctcgagtagtcctgttatttctcagcgcgtaaagcatggctttgttggtggagaaaaccacgagtggtcgcgagtacaaggtcaangacctttcccaggccgacttcggccgcctcgagatcgagctggccgaggttgagatgcccggcctcatggcctgtcggaccgagttcggcccctcccagcccttcaagggggcccgcatcaccggctccctccacatgaccatcnantcaaangttctcattgagaccctcaccgcccttggcgccgaggtc

SEQ ID NO: 3078 - DNA, 325 bp, Glycine max
  unsure (1)..(325): unsure at all n locations
ncnatgcacgcgtacgtaagctcggaattcggctcgagctcaccactccctccactctctttctctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagancgccgttctcattgagaccctcaccgccctt

SEQ ID NO: 3079 - DNA, 307 bp, Glycine max
  unsure (1)..(307): unsure at all n locations
gnantngtcgcacgcacgcgtacgtaagctcggaattcggctcgaggnggtttctgaggaaaccaccactggagttaagaggctctatcagatgcaggcgaatggnactcttctcttccctgctattaatgtcaatgactctgtcaccangagcaagtttgacaacttgtatgggngccgtcactctctccctgatggtctcatganngctaccgatnttatgattgctggaaaggtggctgttgtggcnggatatggtgatgttggcangggttgtgctgctncaatnnagcaggctggtgctcnc

SEQ ID NO: 3080 - DNA, 303 bp, Glycine max
  unsure (1)..(303): unsure at all n locations
nntncnanagtcgcatgcacgcgtacgtaagctcggaattcggctcgagtatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagancgccgttctcattgagaccctcaccgcccttggn

SEQ ID NO: 3081 - DNA, 293 bp, Glycine max
  unsure (1)..(293): unsure at all n locations
tcgcangcacgcgtacgtaagctcggaattcggctcgaggttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagaccgccgttctcattgagaccctcaccgcccttg

SEQ ID NO: 3082 - DNA, 309 bp, Glycine max
  unsure (1)..(309): unsure at all n locations
agtcgcatgtntagtacgtaagctcggaattcggctcgagctctagtcctgttatttctcagcgcgtaaagcatggctttgttggtggagaaaaccacgagtggtcgcgagtacaaggtcaaggacctttcccaggccgacttcggccgcctcgagatcgagctggccgaggtcgagatgcccggcctcatggcctgttcggaccgagttcggcccctcccagcccttcaagggggcccgcatcaccggctccctccacatgaccatccagaccgccgttctcattgagaccctcaccgcccttggcgc

SEQ ID NO: 3083 - DNA, 295 bp, Glycine max
tcgcatgcacgcgtacgtaagctcggaattcggctcgagctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagaccgccgttctcattgagaccctcaccg

SEQ ID NO: 3084 - DNA, 303 bp, Glycine max
  unsure (1)..(303): unsure at all n locations
gaanggncaatgcancgtacgtaagctcggaattcggctcgaggtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagancnncgttctcattgagaccctcaccgcccttgg

SEQ ID NO: 3085 - DNA, 293 bp, Glycine max
  unsure (1)..(293): unsure at all n locations
gtcgcnngcacgcgtacgtaagctcggaattcggctcgagtagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagaccgccgttctcattgagaccctcac

SEQ ID NO: 3086 - DNA, 322 bp, Glycine max
  unsure (1)..(322): unsure at all n locations
gtcgcntagncncgtacgtnagctcggaattnggctcgngctcgagccgcctcgagccgctcgagccggtcctgttatttctcagcgcgtaaagcatgnctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagancgccgttctcattgagaccctcaccgc

SEQ ID NO: 3087 - DNA, 299 bp, Glycine max
  unsure (1)..(299): unsure at all n locations
attcgcangcacgcgtacgtaagctcggaattcggctcgagnatgtcctgctccttcaccaaccaggtcattgctcagcttgagttgtggaaggagaagagtaccggcaagtacgagaagaaagtttacgttttgcccaagcaccttgatgagaaggtggctgcacttcaccttggcaaacttggagctaagctcaccaagcttagcccggcccaggctgattacatcagtgtgcctgttgagggtccatacaagcctgctcattacaggtactaagtaattgagattatcaacggaaa

SEQ ID NO: 3088 - DNA, 321 bp, Glycine max
  unsure (1)..(321): unsure at all n locations
gtcgcangcacgcgtacgtaagctcggaattnggctcgngctcgagccgctcgagccgctcgagccggtcctgttatttctcagcgcgtaaagcatggnnttgttggnggagaaaaccacgngtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagaccgccgttctcattgagaccctcaccgc

SEQ ID NO: 3089 - DNA, 304 bp, Glycine max
tgcatagtcgcatgcacgcgtacgtaagctcggaattcggctcgagtctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagtccgccgttctcattgagaccctcaccgc

SEQ ID NO: 3090 - DNA, 318 bp, Glycine max
  unsure (1)..(318): unsure at all n locations
tcncangcacgcgtacgtaagctcggaattcggctcgagccactctctttctctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagaccgccgttctcattgagaccctcaccccttggcgccg

SEQ ID NO: 3091 - DNA, 279 bp, Glycine max
  unsure (1)..(279): unsure at all n locations
gtcgcatgcacgcgtacgtaagctcggaattcggctcgaggaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagaccgccgttctcattgagaccctcaccgcccttggcgnngacnncgggnnctnaaaaa

SEQ ID NO: 3092 - DNA, 301 bp, Glycine max
  unsure (1)..(301): unsure at all n locations
gcacgcgtacgtaagctcggaattcggctcgagnttctctagtcctgttatttctcagcgcgtaaagcatggctttgttggtggagaaaaccacgagtggtcgcnagtacaaggtcaaggacctttcccaggccgacttcngccgcctcgagatcgagctggccgaggttgagatgcccggcctcatggcctgtcggaccgagttcggcccctcccagcccttcaagggggcccgcatcaccggctccctccanatgaccatccagaccgccgttctcattgagacnctcaccgcccttgg

SEQ ID NO: 3093 - DNA, 242 bp, Glycine max
  unsure (1)..(242): unsure at all n locations
aggacatcatcatggttgaccacatgaagaaaatgaagaacaatgccattgtttgcaacattggtcactttgacaatgagatcgacatgctggggctggagaactaccccggcgtgangcgcatcaccatcaagccccaaaccgacagatgggtctccccgagaccaatgtcggcatcattgtctggccgagggtcgtttgatgaacttgggatgcgccacaggacaccctagttttgtgat

SEQ ID NO: 3094 - DNA, 303 bp, Glycine max
  unsure (1)..(303): unsure at all n locations
nngcacgcgtacgtaagctcggaattcggctcgagctctctttctctagtcctgttatttctcagcgcgtaaagcatggctttgttggtggagaaaaccacgagtggtcgcgagtacaaggtcaaggacctttcccaggccgacttcggccgcctcgagatcgagctggccgaggtcgagatgcccggcctcatggcctgtcggaccgagttcggcccctcccagcccttcaagggggcccgcatcaccggctcctccacatgaccatccagaccgccgttctcattgagaccctcaccgccc

SEQ ID NO: 3095 - DNA, 311 bp, Glycine max
  unsure (1)..(311): unsure at all n locations
gtcgnngcacgcgtacgtaagctcggaattcggctcgagagaccctccaggagtactggtggtgcaccgagcgcgccctcgactggggccccggtggtggacccgacctcatcgtcgacgacggtggtgacgctacccttctcatccacgaaggcgtcaaggccgaggagctctatgagaagaccggcgaactccccgaccccaactccaccgacaacgccgagtttcagatcgtgcttaccattcatcagagatgggttgaagaccgatcccaccagttaccgcaagatgaaggagcgtctcgttggggt

SEQ ID NO: 3096 - DNA, 316 bp, Glycine max
  unsure (1)..(316): unsure at all n locations
agnanatgaagcgtacgtaagctcggaattcggctcgagctctagtcctgttatttctcagcgcgtaaagcatgggcttnnttggtggagaaaaccacgagtggtcgcgagtacaaggtcaaggacctttcccaggccgacttcggccgcctcgagatcgagctggccgaggttgagatgcccggcctcatggcntgtcggaccgagttcggcccctcccagcccttcaagggggcccgcatcaccggctccctccacntgaccatccananagncgtctcattgagaccctcaccgcccttggcgccgaggtccg

SEQ ID NO: 3097 - DNA, 309 bp, Glycine max
  unsure (1)..(309): unsure at all n locations
ngcncgcgtncgtnngctcggnnttcggctcgagctctttctctngtcctgtnntttctcagcgcgtaangcntggctttgttggtggagaaaaccacgagtggtcgcgagtncaaggtcnaggncctttcccaggccgncttcggccgcctcgagatcgagctggccgaggttgagnngcccggcctcatggcctgtcggaccgagttcggcccctcccancccttcaagggggcccgcatcaccggctccctccacatgaccntccagaccgccgttctcattgagaccctcancgcccttggcgcc

SEQ ID NO: 3098 - DNA, 272 bp, Glycine max
  unsure (1)..(272): unsure at all n locations
agtcgcangcacgcgtacgtaagctcggaattcggctcgaggcaagatgaaggagcgtctcgttggggtttctgaggaaaccaccactggagttaagaggctctatcagatgcaggcgaatgggactcttctcttccctgctattaatgtcaatgactctgtcaccaagagcaagtttgacaacttgtatgggtgccgtcactctctccctgatggtctcatgagggctaccgatgttatgattgctggaaaggtggctgttgtggctggat

SEQ ID NO: 3099 - DNA, 339 bp, Glycine max
  unsure (1)..(339): unsure at all n locations
ctgtganttctcagcgcgtaaagcatggctttgttggtggagaaanccacgagtggtcgcgantacaangtgcaagganctttcccaggccgacttcggcngnctcgagatcgagctggccgaggttgagatgcccggcctcatggcctgtcggnccgagttcggcncctcccagcccttcaagggggcncgcatcaccggntccctccacatgaccatccagancgccgttctcatttgagatcctnatcgcccttggngccgnaggtccgctggtgctcctgnaacatcgtctccatccaggaccacgccncngccgctattgcccgganagtgccg

SEQ ID NO: 3100 - DNA, 262 bp, Glycine max
gtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagctccgccgttctcattgagaccctcaccgcccttggc

SEQ ID NO: 3101 - DNA, 276 bp, Glycine max
  unsure (1)..(276): unsure at all n locations
gtcgcatgcacgcgtacgtaagctcggaattcggctcgagggttgtgctgctgcattgaagcaggctggtgctcgtgtcatcgtgactgagattgaccccatttnggcccttnaggttctcatggaaggccttcaggttctgaccttggaggatgttgtttctgaggctgatatctttgtcaccaccacgggtaacaaggacatcatcatggttgaccacatgaagaaaatgangancantgccattgtttgcaacattggtcactttgacaatga

SEQ ID NO: 3102 - DNA, 296 bp, Glycine max
  unsure (1)..(296): unsure at all n locations
cgtcgcatgcacgcgtncgtnagctcggnattcggctcgagctttctctagtcctgttntttctcagcgcgtaaagcatggctttnttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagaccgccgttctcattgagacc

SEQ ID NO: 3103 - DNA, 294 bp, Glycine max
  unsure (1)..(294): unsure at all n locations
tcgcangcacgcgtacgtaaagctcggaattcngctcgagngcccgcatcaccggctccctttcacatgaccatccagaccgctgtcctcatcgagaccctcaccgctctcggcgccgaggttcgctggtgctcctgcaacatcttctccactcaggaccacgccgccgccgccatcgcccgtgacagcgccgccgtcttcgcctggaagggtgagaccctccaggagtactggtngtgcaccgagcncgccctcgactggggccccggcggcggccccgacctcatcgtcgac

SEQ ID NO: 3104 - DNA, 291 bp, Glycine max
  unsure (1)..(291): unsure at all n locations
tcgnnngcacgcgtacgtaagctcggaattcggctcgagctagtcctgttatttctcagcgcgtaaagcatggctttgttggtggagaaaaccacgagtggtcgcgagtacaaggtcaaggacctttcccaggccgacttcggccncctcgagatcgagctggccgaggttgagatgcccggcctcatggcctgtcggaccgagttcggcccctcccagcccttcaagggggcccgcatcaccggctccctccacatgaccatccagaccgccgttctcattgagaccctc

SEQ ID NO: 3105 - DNA, 311 bp, Glycine max
  unsure (1)..(311): unsure at all n locations
cgcangcacgcgtacgtnagctcggaattcggctcgagncccgacctcatcgtcgacgacggtggtgacgctacccttctcatccacgaaggcgtcaaggccgaggagctctatgagaagaccggcgaactccccgaccccaactccaccgacaacgccgagtttcagatcgtgcttaccatcatcagagatgggttgaagaccgatcccaccaggtaccgcaagatgaaggagcgtctcgttggggtttctgaggaaaccaccactggagttaagaggctctatcagatgcaggcgattgggccntttnt

SEQ ID NO: 3106 - DNA, 301 bp, Glycine max
  unsure (1)..(301): unsure at all n locations
ngtcncatgcacgcgtacgtaagctcggaattcggctcgagctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgttcggaccgagttcggcccctcccagcccttcaagggggcccgcatcaccggctccctccacatgaccatccagaccgccgttctcattgagaccctcaccgccttgncgccgaggtccg

SEQ ID NO: 3107 - DNA, 291 bp, Glycine max
  unsure (1)..(291): unsure at all n locations
cgcangcacgcgtacgtaagctcggaattcggctcgaggaggaaaccaccactggagttaagaggctctatcagatgcaggcgaatgggactcttctcttccctgctattaatgtcaatgactctgtcaccaagagcaagtttgacaacttgtatgggtgccgtcatctctccctgatggtctcatgagggctaccgatgttatgattgctggaaaggtggctgttgtggctggatatggtgatgttggcaagggttgtgctgctgcaatgangcaggtggtccccgttca

SEQ ID NO: 3108 - DNA, 298 bp, Glycine max
  unsure (1)..(298): unsure at all n locations
tttangcacgcntacgtaagctcggaattcggctcgagtccaggagtactggtggtgcaccgagcgcgccctcgactggggccccggtggtggacccgacctcatcgtcgacgacggtggtgacgctacccttctcatccacgaaggcgtcaaggccgaggagctctatgagaaaccggcgaactccccgaccccaactccaccgacaacgccgagattcagatcgtgcttaccatcatcagagatgggttgaagaccgatcccaccaggtaccgcaagatgaaggagcgtctcgttg

SEQ ID NO: 3109 - DNA, 341 bp, Glycine max
  unsure (1)..(341): unsure at all n locations
gtcgcntgaagcgnangcacgcgtacgtaagctcggaattcggctcgaggaaaatgaagaacaatgccattgtttgcaacattggtcactttgacaatgagatcgacatgctggggctggagaactaccccggcgtgaagcgcatcaccatcaagccccaaacngacagatgggtcttccccgagaccaatgtcggcatcattgtcttggccgagggtcgtttgatgaacttgggatgcgccacaggacaccctagttttgtgatgtctgtnccttcaccaaccaggtcatgctcagttgagttgtggaaangagaagagtaccggcaagtacgagaagna

SEQ ID NO: 3110 - DNA, 279 bp, Glycine max
  unsure (1)..(279): unsure at all n locations
ngtcgcatgcacgcgtacgtaagctcggaattcggctcgagcggctcgaggcaacatcttctccacccaggaccangccgccgccgctattgcccgcgacagtgcngccgtcttcgcctggaagggtganaccctccaggagtactggtggtgcaccgagcgcgccctcgactggggccccggtggtggacccgacctcatcgtcgacgacggtggtgacgctacccttctcatccacgaaggcgtcaaggccgaggagctctatnagaagaccggcga

SEQ ID NO: 3111 - DNA, 271 bp, Glycine max
  unsure (1)..(271): unsure at all n locations
ccaccangtaccgcaagatgaaggagcgtctcgttggggtttctgaggaaaccaccactggtgttaanangctatatcagatncaggcnaatgggantctactcttccctgctattaatgtcaatgactctgttaccaagagcaagtttgacaacttgtacgggtgccgtcactctctccctgatggtctgatgagggctactgatgtgatgattgctggaaaggtggctgttgnggcccggatanggtgatnttggcaagggttgngcnc

SEQ ID NO: 3112 - DNA, 293 bp, Glycine max
  unsure (1)..(293): unsure at all n locations
agtcgcangcacgcgtacgtaagctcggaattcggctcgagtctctagtcctgttatttctcagcgcgtaaagcatggctttgttggtggagaaaaccacgantggtcgcgagtacaaggtcaaggacctttcccaggccgacttcggcngcctcgagatcgagctggccgaggttgagatgcccggcctcatggcctgtcggaccgagttcggcccctcccagcccttcaagggggcccgcatcaccggctccctccacatgaccatccagaccgccgttctcattgagacc

SEQ ID NO: 3113 - DNA, 301 bp, Glycine max
  unsure (1)..(301): unsure at all n locations
nngtcgcangcacgcgtacgtaagctcggaattcggctcgagtctttctctagtcctgttatttctcagcgcgtaaagcatggctttgttggtggagaaaaccacgagtngtcgcgagtacaaggtcaaggacctttcccaggccgacttcggccgcctcgagatcgagctggccgaggttgagatgcccggcctcatggcctgtcggaccgagttcggcccctcccagcccttcangggggcccgcatcaccggctccctccacatgaccatccagaccgccgttctcattgagaccctn

SEQ ID NO: 3114 - DNA, 283 bp, Glycine max
  unsure (1)..(283): unsure at all n locations
tcgcangcacgcgtacgtaagctcggaattcggctcgagtnggccgcctcgagatcgagctggccgaggttgagatgccgggcctcatggcctgccggaccgagttcggcccatctccagcccttcaagggggcccgcatcaccggcncccttcacatgaccatcnagaccgctgtcctcatcgagaccctcaccgctctcggcgccgaggttcgctggtgctcctgcaacatcttctccactcaggaccacgccgccgccgccatcgcccgtgacagcgccg

SEQ ID NO: 3115 - DNA, 313 bp, Glycine max
  unsure (1)..(313): unsure at all n locations
gtcgcangcacgcgtacgtnnagctcggaattcggctcgagctttctctagtcctgttatttctcagcgcgtaaagcatggctttgtnggtggagaaaaccacgagtggtcgcgagtacaaggtcaaggacctttcccaggccgacttcggccgcctcgagatcgagctggccgaggttganatgcccggcctcatggcctgtcggaccgagttcggcccctcccagcccttcaagggggcccgcatcaccggctccctccacatgccatccagaccgccgttctcattganaccctnacngcccttgggcga

SEQ ID NO: 3116 - DNA, 305 bp, Glycine max
  unsure (1)..(305): unsure at all n locations
ncgtcgcatgcacgcgtacgtnagctcggaattcggctcgagctctttctctagtcctgttatttctcagcgcgtaaagcatggctttgttggtggagaaaaccacgagtggtcgcgagtacaaggncnaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagancgccgttctcattgagacctcaccg

SEQ ID NO: 3117 - DNA, 279 bp, Glycine max
  unsure (1)..(279): unsure at all n locations
gtcgcangcacgcgtacgtaagctcggaattcggctcgaggttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagacagccgttctcattgaga

SEQ ID NO: 3118 - DNA, 301 bp, Glycine max
  unsure (1)..(301): unsure at all n locations
agtcgcangcacgcgtacgtaagctcggaattcggctcgagntagtcctgttatttctcagcgcgtaaagcatggctttgttggtggagaaaaccacgagtggtgcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagaccgccgttctcattgagaccctcaccgccc

SEQ ID NO: 3119 - DNA, 322 bp, Glycine max
  unsure (1)..(322): unsure at all n locations
ngatgntgcnnncgcccggnagatcggaaatncgggctcgagctgtgacctntcaggatctcanggnaggccttcaggntctgaccttngaggatgttngttctgaggctgatatcngtgtcaccanccancggtaacaaggacatcatcatggttgaccacatganganaatgaagaacaatgccattgtttgcaacattggtcatttgacaatgagatcgacatgcttgggctggagaactaccccggcgtgaagcgcatcaccatcaagccccaaactgacagatgggtcttccctgagaccaacaccggatcatgtct

SEQ ID NO: 3120 - DNA, 293 bp, Glycine max
  unsure (1)..(293): unsure at all n locations
gtcgcangcacgcgtacgtaagctcggaattcggctcgagctctttctctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgnccggcctcatggcctgtcggaccgagttcggcccctcccagcccttcaagggggcccgcatcaccggctccctccacatgaccatccagatcgccgttctcattga

SEQ ID NO: 3121 - DNA, 313 bp, Glycine max
ttcatgcacgcgtacgtaagctcggaattcggctcgaggagagagagagagatctatctatctatcaagatggcgttgttggttgagaaaacaagcagtggaagggagtacaaggtgaaggacatgacgcaagccgatttcggaagattggaaatcgagctggcggaggttgaaatgcccggcctcatgtcctcccgcaccgagttcggcccctctcaacccttcaagggcgctaggatcaccggctccctccacatgaccatccaaaccgccgtcctcatcgagaccctcaccgccctcggcgccgaggtcc

SEQ ID NO: 3122 - DNA, 315 bp, Glycine max
  unsure (1)..(315): unsure at all n locations
nngatgnacgcgtacgtnagctcggaattcggctcgagctctttctctagtcctgttatttctcagcgcgtaaagcatggctttgttggtggagaaaaccacgagtggtcgcgagtacaaggtcaaggacctttcccaggcngacttcggccgcctcgagagcgagctggccgaggttgagatgcccggcctcatggcctgtcggaccgagttcggcccctcccagcccttcaagggggcccgcatcaccggctccctccantgaccatccagttccgccgttctcattgagaccctcaccgcccttggcgccga

SEQ ID NO: 3123 - DNA, 297 bp, Glycine max
  unsure (1)..(297): unsure at all n locations
aanagcatgcacgcgtacgtaagctcggaattcggctcgagccactctctttctctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagaccgccgttctcatt

SEQ ID NO: 3124 - DNA, 290 bp, Glycine max
  unsure (1)..(290): unsure at all n locations
gtcgcangcacgcgtacgtaagctcggaattcggctcgagctctttctctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagaccgccgttctcat

SEQ ID NO: 3125 - DNA, 273 bp, Glycine max
  unsure (1)..(273): unsure at all n locations
angtcgcangcacgcgtacgtnagctcggaattcggctcgagagaaaatgaagaacaatgccattgtttncaacattggtcactttgacaatgagatcgacatgctggggctgganaactaccccggcgtgangcgcatcaccatcaagccccaaaccgacagatggtcttccccgagaccaatgtcggcatcattgtcttggccgagggtcgtttgatgaacttgggatgcgccacaggacaccctagttttntgatgncctgctccttcac

SEQ ID NO: 3126 - DNA, 289 bp, Glycine max
  unsure (1)..(289): unsure at all n locations
ctncgcangcncgcgtacgtaagctcggaattcggctcgagctctttctctagtcctgttatttctcagcgcgtaaagcatggctntgttggtggagaaaaccacgagtggtcgcgngtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagancgccgttctc

SEQ ID NO: 3127 - DNA, 310 bp, Glycine max
  unsure (1)..(310): unsure at all n locations
anncacgcgtacgtaagctcngaattcggctcgagctctttctctagtcctgtnatttcncancgngtaaagcatggctttnttggtggagaaaaccacgagtngtcgcnagtacaatgtcaaggacctttcccaggccgacttcggncgcctngagatcganctggccgaggttganangcacggcctcatggcctgtcggaccgagttcngcccctcccancccttcaagggggcccgcatcaccggctccctccacatgaccatccagaccggcgttctcattgagaccctcaccgncttggcgccg

SEQ ID NO: 3128 - DNA, 292 bp, Glycine max
  unsure (1)..(292): unsure at all n locations
agtcgcangcacgcgtacgtaagctcggaattcggctcgaggcgccctcgactggggccccggtggtggacccgacctcatcgtcgacgacggtggtgacgctacccttctcatccacgaaggcgtcaaggccgaggagctctatgagaagaccggcgaactccccgaccccaactccaccgacaacgccgagtttcagatcgtgcttaccatcatcagagatgggttgaagaccgatcccaccaggtaccgcaagatgaaggagcgtctcgttggggtttctgaggaaacc

SEQ ID NO: 3129 - DNA, 299 bp, Glycine max
  unsure (1)..(299): unsure at all n locations
nnngtatgcacgcgtacgtaagctcggaattcggctcgagctttctctagtcctgttatttctcagcgcgtaaagcatggctttgttggtggagaaaaccacncgtggtgcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagancgccgttctcattgagaccctc

SEQ ID NO: 3130 - DNA, 325 bp, Glycine max
  unsure (1)..(325): unsure at all n locations
aaaaaagnaangtcgcatgcacgcgtacgtaagctcggaattcggctcgagtcctgttatttctcagcgcgtaaagcatggctttgttggtggagaaaaccacgagtggtccgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagaccgccgttctcattgagacctcaccgccttggcgccgaggtcgctnnn

SEQ ID NO: 3131 - DNA, 273 bp, Glycine max
  unsure (1)..(273): unsure at all n locations
aacgcgtangtaagctcggaattcggctcgagntttctcagcgcgtaaagcatggctttgttggtggagaaaaccacgagtggtcgcgagtacaaggtcaaggacctttcccaggccgacttcggccgcctcgagatcgagctggccgaggttnagatgcncggcctcatggcctgtcggaccgagttcggnncctnccagcccttcaagggggcncgcatcancggntccctccacatgaccatcnagnccgccgttctcattgagaccctc

SEQ ID NO: 3132 - DNA, 286 bp, Glycine max
  unsure (1)..(286): unsure at all n locations
gtcgcangcacgcgtacgtaagctcggaattcggctcgagctctttctctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagangcccggcctcatggcctgtcggaccgagttcggcccctcccagcccttcaagggggcccgcatcaccggctccctccacatgaccatccagaccgccgttc

SEQ ID NO: 3133 - DNA, 288 bp, Glycine max
  unsure (1)..(288): unsure at all n locations
gtcgcangcacgcgtacgtaagctcggaattcggctcgagctctttctctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagangcccggcctcatggcctgtcggaccgagttcggcccctcccagcccttcaagggggcccgcatcaccggctccctccacatgaccatccagatcgccgttctc

SEQ ID NO: 3134 - DNA, 289 bp, Glycine max
  unsure (1)..(289): unsure at all n locations
tcgcangcangcacgcgtacgtaagctcggaattcggctcgaggttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccanatgaccatncagaccgccgtccctcattgagaccctca

SEQ ID NO: 3135 - DNA, 289 bp, Glycine max
  unsure (1)..(289): unsure at all n locations
nacgtcgcatgcacgcgtacgtaagctcggaattcggctcgaggtcgacgacggtggtgacgctacccttctcatccacgaaggcgtcaaggccgaggagctctatgagaagaccggcgaactccccgaccccaactccaccgacaacgccgagtttcagatcgtgcttaccatcatcagagatgggttgaagaccgatcccaccaggtaccgcaagatgaaggagcgtctcgttggggtttctgaggaaaccaccactggagttaagaggctctatcagatgcaggcg

SEQ ID NO: 3136 - DNA, 281 bp, Glycine max
  unsure (1)..(281): unsure at all n locations
tcgcatgcacgcgtacgtaagctcggaattcggctcgagctagtcctgttatttctcagcgcgnaaagcatggctttgttggtggagaaaaccacgagtggtcgcgagtacaaggtcaaggacctttcccagnccgacttcggccgcctcgagatcgagctggccgaggttgagatgcccggcctcatggcctgtcggaccgagttcggcccctcccagcccttcaagggggcccgcatcaccggctccctccacatgaccatccatgacaccgttctcat

SEQ ID NO: 3137 - DNA, 301 bp, Glycine max
  unsure (1)..(301): unsure at all n locations
gtcgctgcacgcgtacgtaagctcggaattcggctcgagctagttttgtgatgtcctgctcnttcaccannccaggtcattgctcagcttgagttgtggaaggagaagagtaccggcaagtacgagaagaaagtttacgttttgcccaagcaccttgatgagaaggtggctgcacttcaccttggcaaanttggagctaagctcaccaagcttagcccggcccaggctgattacatcagtgtgcctgttgagggtccatacaagcctgctcattacaggtactaagtaattgagattatca

SEQ ID NO: 3138 - DNA, 286 bp, Glycine max
  unsure (1)..(286): unsure at all n locations
acgtcgcatgcacgcgtacgtaagctcggaattcggctcgagctttctctagtcctgttatntctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggnctgtcggaccgagttcggcccctcccagcccttcaagggggnccgcatcaccggctccctccacatgaccatccagancgccgttn

SEQ ID NO: 3139 - DNA, 270 bp, Glycine max
  unsure (1)..(270): unsure at all n locations
ngatcgcntnaagtcgcangcacgcgtacgtangctcggnaattcggctcgagntgacaacttgtacnggtgccgtcactctctccctganggtctgatgagggctactgatgtgatgattgctggaaaggtggctgttgtggctggatatggtgatgttggcaagggttgtgctgctgcattgaagcaggctggtgctcgtgtcatcgtgactgagattgaccccatttgtgcccttcaggctctcatggaaggcctcagttctgacct

SEQ ID NO: 3140 - DNA, 298 bp, Glycine max
  unsure (1)..(298): unsure at all n locations
ncgattgcacgcgtacgtnagctcggaattcggctcgagnngagaccctccaggagtactggtggtgcaccgagcgcgccctacgactggggccccggtggtggacccgacctcatcgtcgacgacggtgangacgctacccttctcatccacgaaggcgtcaaggccgaggantctatgagacgaccggcgaactccccgaccccaactccaccgacaacgccgagtttcagatcgtgcttaccatcatcnganatgggttgaagaccgatcccaccaggtaccgcaagatgaagga

SEQ ID NO: 3141 - DNA, 334 bp, Glycine max
  unsure (1)..(334): unsure at all n locations
gangacgcgtacgtnagctcggaattccgctcgagctcgagccggggaaaccaacactggagttaagaggctctatcagatgcnaggcgaatgggattcctctcttccngntaataaatgtcaatgactcntgtcaccangagcnagtttgacaacttgtatgggtgccgtncactctctccctgatggtctcatgagggctaccgatgttatgattgctggaaaggtggctgttgtngctggatatggtgatgttggcaanggttgtgctgctgcaatgnagcaggctggtgctcgtgtcatcgtgnacgagattgatcccatctgtgccctc

SEQ ID NO: 3142 - DNA, 266 bp, Glycine max
  unsure (1)..(266): unsure at all n locations
ctctctttctctagtcctgttatttctcancgcgtanagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatnacnaanaaatnncnaantctcattgagaccctcancg

SEQ ID NO: 3143 - DNA, 288 bp, Glycine max
  unsure (1)..(288): unsure at all n locations
ntgcncnngtacgtaagctcggaattcggctcgagctctttctctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccaganncgccgttctcattg

SEQ ID NO: 3144 - DNA, 308 bp, Glycine max
  unsure (1)..(308): unsure at all n locations
ncacgcgtacgtnagctcggaattcggctcgagcctcgacgacggtggtgacgctacccttctcatccacgaaggcgtcaaggccgaggagctctatgagaagaccggcgaactccccgaccccaactccaccgacaacgccgagtttcagatcgtgcttancatcatcagagatgggttgaagaccgatcccaccaggtancgcaagatgaaggagcgtctcgttggggtttctgaggaaaccaccattggagttaagaggntctatcagatgcaggcgaatgggatcttctcttccctgctattaa

SEQ ID NO: 3145 - DNA, 279 bp, Glycine max
  unsure (1)..(279): unsure at all n locations
nntcgcatgcacgcgtacgtaagctcggaattcggctcgagctctttctctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagac

SEQ ID NO: 3146 - DNA, 296 bp, Glycine max
  unsure (1)..(296): unsure at all n locations
cgtcgcangcacgcgtacgtnagctcggaattcggctcgagngcgacgccaccctcctcatccacgagggcgtcaaggccgaggagctctatgagaagaccggggaactccccgaccctaactccactgacaacgccgagntccagatcgtgcttaccatcatcagagatgggttgaagaccgatcccaccaggtaccgcaagatgaaggagcgtctcgttggggtttctgaggaaaccaccactggtgttaagaggctatatcagatgcaggcgaatgggactctactcttccct

SEQ ID NO: 3147 - DNA, 287 bp, Glycine max
gtcgcatgcacgcgtacgtaagctcggaattcggctcgagcgtaaagcatggctttgttggtggagaaaaccacgagtggtcgcgagttacaaggtcaaggacctttcccaggccgacttcggccgcctcgagatcgagctggccgaggttgagatgcccggcctcaggcctgttcggaccgagttcggcccctcccagcccttcaagggggcccgcatcaccggctccctccacatgaccatccagaccgccgttctcatgagaccctcaccgcccttggcgccga

SEQ ID NO: 3148 - DNA, 275 bp, Glycine max
  unsure (1)..(275): unsure at all n locations
gtcgcangcacgcgtacgtaagctcggaattcggctcgagctctttctctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatcca

SEQ ID NO: 3149 - DNA, 239 bp, Glycine max
  unsure (1)..(239): unsure at all n locations
atcgtacgtaagctcggaattcggctcgagcttcaccaaccaggtcattgctcagnttgagttgtggatggagaagagtaccggcaagtacgagaagaaggtttacgttttgcccaagcaccttgatgagaaggtggctgcacttcacctgggcaaacttggngctaagctgacccagcttagcaagtcccaggctgattacatcagtgtgcctgttgagggtccatacaagcctgctc

SEQ ID NO: 3150 - DNA, 270 bp, Glycine max
  unsure (1)..(270): unsure at all n locations
gtcgcangcacgcgtacgtaagctcggaattcggctcgagctttctctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccat

SEQ ID NO: 3151 - DNA, 290 bp, Glycine max
  unsure (1)..(290): unsure at all n locations
gtcgcangcacgcgtacgtaagctcgggaattcggctcgaggtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatnacannnnacngaaaaatgctcattgagacccttcaccgccnntgggggcgngg

SEQ ID NO: 3152 - DNA, 310 bp, Glycine max
  unsure (1)..(310): unsure at all n locations
agcannagntcnngangcgtacgtaagtcgganttcggctcgagntctttctctagtcntgttatttctcagcggcgtaaagcatgggtttgttgatggagnaaaccaacgagtcgttngcgagtacaaggtcaaggacctttcccaggccgacttcggccgcctcgagatcgagctggccgaggttgagatgcccggcctcatggcctgtcggancgagttcggcccctcccagcccttcaagggggcccgcatcaccggctccctccanatgaccatccagaccgccgttctcattgagagctcacgc

SEQ ID NO: 3153 - DNA, 277 bp, Glycine max
  unsure (1)..(277): unsure at all n locations
gtcgcangcacgcgtacgtaagctcggaattcggctcgagctagtcctgttatttctcagcgcgtaaagcatggctttgttggtggagaaaaccacnagtggtacgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatgaccatccagaccgccgt

SEQ ID NO: 3154 - DNA, 298 bp, Glycine max
  unsure (1)..(298): unsure at all n locations
gcangcacgcgtacgtaagctcggaattcggctcgagctctctttctctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctntcggaccgagttnggccccgnccagcccgtnaagggggcccgcatcnccggcgctcgcnacaggatcanccagaccgccgttctcagtganacccg

SEQ ID NO: 3155 - DNA, 318 bp, Glycine max
  unsure (1)..(318): unsure at all n locations
ngtcgcatgcacgcgtacgtaagctcggnaattnnngctcgagctcgagccgctncgagccgctccactctctttctctagtcctgttatttctcagcgcgtaaancatggctnanttggtggagaaaaccacgagtggtcgcnagtacaaggtcaaggacctttcccaggccgacttcggcgcctcgagatcgagctggccgnggttgagatgcccggcctcatggcctgtncggaccgagttcggcccctcccagcccttcaagggggcccgcatcaccggctccctccacatgaccatccagaccgccgttctca

SEQ ID NO: 3156 - DNA, 318 bp, Glycine max
  unsure (1)..(318): unsure at all n locations
cactctctttctctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatcccggcctcatggcctgtnggaccgagttcggccctcccagccctcaagggggcccgcatcaccggctccctccacatgaccatccagaccgccgttctcattgagacctcacngccttgggccgagtccgttggtgctctgaaanatttctcaaccaaggacaagcng

SEQ ID NO: 3157 - DNA, 292 bp, Glycine max
  unsure (1)..(292): unsure at all n locations
gttgcacgcgtacgtaagctcggaattcggctcgagctctctttctctagtcctgttatttctcngcgcgtaaagcatggctttgttggtggagaaaaccangagtggtcgcgagtacaaggtcaaggacgcttcccaggccgacttcggccgcctcgagatcgagctggccgnggttgagatgcccggcctcatggcctgtcggaccgagttcggcccctcccagcccttcaagggggcccgcatcaccggctccctccacatnacanncgacngcancgttctcattgan

SEQ ID NO: 3158 - DNA, 278 bp, Glycine max
  unsure (1)..(278): unsure at all n locations
tcgcangcacgcgtacgtnagctcggaattcggctcgagntttctctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttcggcccctcccagcccttcaagggggcccgcatcaccggctccctccacatggaccatccagaccg

SEQ ID NO: 3159 - DNA, 332 bp, Glycine max
  unsure (1)..(332): unsure at all n locations
acacccncctaccacgccancgnaagctcggaattnggctcgagattcaccaacccaggtcattgctcagttgagttgtggaaggagnagagtaccggcaagtacgagaagaaggtttacgttttgcncaagcaccttgatgagaaggtggctgcacttaacctgggcaaacttgnagctaagctgacccagcttagcaagtnccaggntgattacatcagtgtgcctgttgagggtccatacaagcctgctcantacaggtacnnnctnatnnngatgatcaactgnaaagtgagtgagggaaagacaaaaatgggttttatnaatnggat

SEQ ID NO: 3160 - DNA, 288 bp, Glycine max
  unsure (1)..(288): unsure at all n locations
tcgcangcacgcgtacgtaagctcggaattcggctcgagctctttctctagtcctgttatttctcagcgcgtaaagcatggctttgttggtggagaaaaccacgagtggtcgcgagtacaaggtcaaggacctttcccaggccgacttcggccgcctcgagatcgagtggccgaggttgagatgcccggcctcatggcctntcggaccgagttcggcccctcccagcccttcaagggggcccgcatcaccggctccctccacatgaccatccagnngccgttctcatt

SEQ ID NO: 3161 - DNA, 282 bp, Glycine max
  unsure (1)..(282): unsure at all n locations
tcgcatgcacgcgtacgtaagctcggaattcggctcgagctctttctctagtcctgttatttctcagcgcgtaaagcatggctttgttggtggagataaccacnnctggtccncgagtacaaggtcaaggacctttcccangccgacttcggccgcctcgagatcgagctggccgaggttgagatgcncggcctcatggcctgtcggaccgagttcggcccctcccagcccttcaagggggcccgcatcaccggntccctccacatgancatccagaccgcc

SEQ ID NO: 3162 - DNA, 318 bp, Glycine max
  unsure (1)..(318): unsure at all n locations
cgcacgncgcgaacnnnagcncgcgaattcggntcgagngngcccncgactggggccccggtggtggacaccgacctcatcgtcgacgacggtggtgangnnacnctnctcatccacnaaggcgtcaangccnaggagcncnatgagaagaccggcgaantcnccgannccaactccaccganaacgccgagctgcagatcgngcttaccatcancagagangggttgaagaccgancccatnaggnancgcaagatgaaggagcgtctcgttggggtntctgaggnnaccancactggagttaagaggctcnatcag

SEQ ID NO: 3163 - DNA, 319 bp, Glycine max
  unsure (1)..(319): unsure at all n locations
gtcgcangcacgcgtacgtaagctcggaattcggctcgagacggctgcgagaagacgacagaaggctcagcttgagttgtggaaggagaagagtaccggcaagtacgagaagaaagtttacgttttgcccaagcaccttgatgagaaggtggctgcacttcaccttggcaaacttggagctaagctcaccaagcttagcccggcccaggctgattacatcagtgtgcctgttgagggtccataaagcctgctcattacaggtactaagtaattgagattatcaacggaaagtgagggaaagacaaaatcggttttatga

SEQ ID NO: 3164 - DNA, 294 bp, Glycine max
  unsure (1)..(294): unsure at all n locations
tcgcangcacgcntacgtaagctcggaattcggctcgagcggaaagtgagggaaagacaaaatcggttttatgaatcggattgattgtttaattttcctttgataatctcaattacttagtacctgtaatgagcaggcttgtatggaccctcaacaggcacactgatgtaatcagcctgggccgggctaagcttggtgagcttagctccaagtttgccaaggtgaagtgcagccaccttctcatcaaggtgcttgggcaaaacgtaaactttcttctcgtacttgccggtactc

SEQ ID NO: 3165 - DNA, 294 bp, Glycine max
  unsure (1)..(294): unsure at all n locations
nncgcatgcacgcgtacgtaagctcgggaattcgggctcgagctctttctctagtcctgttatttctcagcgcgtaaagcatgggctttgttggtggagaaaaccacgagtggtcgcgatacaaggtcaaggacctttcccaggccgacttcggccgcctcgagatcgagctggccgaggttgagatgcccggcctcatggcctgtncggaccgagttcggcccctcccagcccttcaagggggcccgcatcaccggctncccttccacatgaccatccagaccgccgttctca

SEQ ID NO: 3166 - DNA, 204 bp, Glycine max
  unsure (1)..(204): unsure at all n locations
cgtcgcangcacgcgtacgtaagctcggaattcggctcgaggtttctgaggaaaccaccactggagttaagaggctctatcagatgcaggcgaatgggactcttctcttccctgctattaatgtcaatgactctgtcaccaagagcaagtttgacaacttgtatgggtgccgtcactctctccctgatggtctcatgagggcta

SEQ ID NO: 3167 - DNA, 203 bp, Glycine max
  unsure (1)..(203): unsure at all n locations
gtcgcangcacgcgtacgtaagctcggaattcggctcgaggtcaccaagagcaagtttgacaacttgtatgggtgccgtcactctctccctgatggtctcatgagggctaccgatgttatgattgctggaaaggtggctgttgtggctggatatggtgatgttggcaagggttgtgctgctgcaatgaagcaggctggtgctc

SEQ ID NO: 3168 - DNA, 266 bp, Glycine max
  unsure (1)..(266): unsure at all n locations
gcaagtacgagaagaaagtttacgttttgcccaagcaccttgatgagaaggtggctgcacttcaccttggcaaacttggngctaagctcaccaagcttagcccggcccaggctgattacatcagtgtgcctgttgagggtccatacaagcctgctcattacaggtactaagtaattgagattatcaacggaaagtgagggaaagacaaaatcggntttatgaatcggattgattgtttaattttcctttttttgaatttttgttgt

SEQ ID NO: 3169 - DNA, 326 bp, Glycine max
  unsure (1)..(326): unsure at all n locations
ntctnntgnangcgtacgtaagctcggaattnngctcgagntcgagcngcgccgtcttcnanntggacagggtgagaccctccagganctactggtggtgcaccgngcgcgccctcgactggggccccggtggtggacccgacctcatcgtnnacgacggtggtgacgctacccttctcatccacgaaggcgtcaaggccgaggagctctntgagaagaccggcgaattcccgancccaantccaccgacaagccggantttcagatcgtgnttancatcatcagagatggttgaagaccgttccaaccaggttacngcagatgaa

SEQ ID NO: 3170 - DNA, 315 bp, Glycine max
  unsure (1)..(315): unsure at all n locations
natcgatgcacgcgtacgtaagctcggnattcggctcganctcgagccgaatcggctcgagggttgaccacatgaagatnatgangancaatgcnattgtanncaacattggnncactttnatcatnagntcgacatnctnggggtggagnactaccccggcgtgangcgcatccaccatcaagccccaaaccgacagatgggtcanccccgagaccaatgtcggcatcattgtcttggccgagggtcgtttgatgaacttgggatgcgccacaggacaccctagttttgtgatgtctgtcctcacnaaccaggt

SEQ ID NO: 3171 - DNA, 274 bp, Glycine max
  unsure (1)..(274): unsure at all n locations
ncgcgtgnacgcgtacgtaagctcggaattcggctcgaggtttcctcaccactccctccattctctttctctagtcctgttatttctcagcgcgtaaagcatggctttgttgtcnggagaanaccacgagtggtcgcgagtacaaggtcaaggacctttcccaggccgacttcggccgcctcgagatcgagctggccgaggttgngatgcccggcctcatggcntgtcggaccgagttcggcccctcccagcccttcaagggggcccgcatcac

SEQ ID NO: 3172 - DNA, 282 bp, Glycine max
  unsure (1)..(282): unsure at all n locations
gtcgcangcacgcgtncggangcacgctcnctttgctctagtgcctgttatttctcancncgtaaagcatggctttgttggtggagaaaaccacnagtggtgcgcgagtacanggtnnaggacctttgcccaggccgacttcngccgcctcgagatcgagctggccgaggttganatgcccggcctcatggcctgttcggaccgagttcggcccctcccancccttcaagggggcccgcatcaccggctccctccacatgaccatccagancgccgttctca

SEQ ID NO: 3173 - DNA, 312 bp, Glycine max
  unsure (1)..(312): unsure at all n locations
acgtcgcangcacgcntacgtaagctcggaattcggctcgagtacgttttgcccaagcaccttgntgagaaggtggctgcacttcacctgggcaaacttggngctaagctgacccagcttagcaagtcccaggctgattacatcagtgtgcctgttgagggtccatacaagcctgctcactacaggtactaagtgattgagatgatcaactgaaaagtgagtgagggaaagacaaaaatcggttttatcaatcggatttgattgtttaattttccttttttgatttttggtgttagactttcagatttgngg

SEQ ID NO: 3174 - DNA, 297 bp, Glycine max
  unsure (1)..(297): unsure at all n locations
angnacangcacgcgtacgtaagctcggaattcggctcgagtgcccaagcaccttgatgagaaggtggctgcacttcacctgggcaaacttggngctaagctgacccagcttagcaagtcncaggctgattacatcagtgtgcctgttgagggtccatacaagcctgctcactacaggtactaagtgattgagatgatcaactgaaaagtgagtgagggaaagacaaaaatcggttttatcaatcggatttgattgtttaattttcctttttttgatttttggtgttagacttttca

SEQ ID NO: 3175 - DNA, 297 bp, Glycine max
  unsure (1)..(297): unsure at all n locations
tcgcntgcacgcgtacgtaagctcggaattcggctcgagtttacgttttgcccaagcaccttgatgagaaggtggctgcacttcanctgggcaaacttggacctaagctgacccagcttagcaagtcccaggctgattacatcagtgtgcctgttgagggtccatacaagcctgctcactacaggtactaagtgattganatgntcaactgaaaagtgagtgagggaaagacaaaaatcgnttttntcaatcggatttgattgtttaattttcctttttttgatttttggtgttaga

SEQ ID NO: 3176 - DNA, 289 bp, Glycine max
  unsure (1)..(289): unsure at all n locations
gtcgcatgcacgcgtacgtaagctcggaattcggctcgagtgcccaagcaccttgatgagaaggtggctgcacttcacctgggcncacttggngctaagctgacccagcttgcncaagtcccaggctgattacatcagtgtgcctgttgagggtccatacaagcctgctcactacaggtactaagtgattgagatgatcaactgaaaagtgagtgagggaaaggacaaaaatcggttttatcaatcggatttgatgtttaattttccttttttgattttggtgttagan

SEQ ID NO: 3177 - DNA, 336 bp, Glycine max
  unsure (1)..(336): unsure at all n locations
gngangcagngtacgtaagctcggaattcggctcgaggagagagagagagagagagagagatctatctatctatcaagatngcgttgttggttgaaaaaaaaaannattganagggantacaaggtgaagganatgatgcaagccgntttnggaagattggaaattcgagctggcggaggttgaaatgcccggcctcatgtcctncccgcaccgagttcggcccctcttcaatccttcaagggcgctaggatcancggctccctccacatgaccatcnanagccgncgtccttcatngagacnctcaccgctctcggcgccgaggtccgctggtgc

SEQ ID NO: 3178 - DNA, 209 bp, Glycine max
  unsure (1)..(209): unsure at all n locations
tnattacncgtacgnaagctcggaattcggntcgagccctccaggagtactggtggtgcaccgagcgcgccctcgactggggccncggtggtggacccgaccttcatcgtcgacgacggtggtgacgntacccttctcatccacgaaggcgtcaaggncgagganctctatgagaanaccggcgaactcgccgancccanctccacaaa

SEQ ID NO: 3179 - DNA, 291 bp, Glycine max
  unsure (1)..(291): unsure at all n locations
nagtcgcangcacgcgtacgtaagctcggaattcggctcgaggctcaccaactcccgctcccatttccttatttatagacagagtctgattgtttcctcaccactccctccantctctttctcctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgcccggcctcatggcctgtcggaccgagttc

SEQ ID NO: 3180 - DNA, 297 bp, Glycine max
  unsure (1)..(297): unsure at all n locations
nacgtcgcatgcacgcgtacgtnagctcggaattcggctcgagtgngaagaccggggaactccccgaccctaactccactgacaacgccgagttccagatcgtgcttaccatcatacagagatgggttgaagaccgatcccaccaggtaccgcaagatgaaggagcgtctcgttggggtttctgaggaaaccaccactggtgttaagaggctatatcagatgcaggcgattgggntntatttcccgctnataataatnncnngnnntctgttaccaagngcngtntnacaacttgnc

SEQ ID NO: 3181 - DNA, 208 bp, Glycine max
  unsure (1)..(208): unsure at all n locations
gtcgcangcacgcgtacgtaagctcggaattcggctcgagtacgttttgcccaagcaccttgatgagaaggtggctgcacttcacctgggcaaacttggngctaagctgacccagcttagcaagtcccaggctgattannncagtgtgcctgttgagggtccatacaagccgctcactacaggtactaagtgattgagatgatcaact

SEQ ID NO: 3182 - DNA, 212 bp, Glycine max
  unsure (1)..(212): unsure at all n locations
gtcgcangcacgcgtacgtaagctcggaattcggctcgagctctctttctctagtcctgttatttctcagcgcgtaaagcatggctttgttggtggagaaaaccacnagtggtcgcgagtacaaggtcaaggacctttcccaggccgacttcggcngcctcgagatcnagctggccgaggttgagatgcccggcctcatggcctgtcggacc

SEQ ID NO: 3183 - DNA, 317 bp, Glycine max
  unsure (1)..(317): unsure at all n locations
aagtncncatgcacgcntacgtaantcggaattcggctcgagctctagtcctgttatttctcancgcgtaaagcatgggctttgttggtggagaaaaccacgagtngtccgctagtacaaggtcaaggacctttcccaggccgacttcngccgcctcgagatcgagctggccgaggttganatgcccggcctcatggcctgtnggaccganttcggccccttcccaacccttcaagggggcccgnatcancggctccctncanatgancatccagaancgcgttntcattgngaccctnancggctttggggcggag

SEQ ID NO: 3184 - DNA, 294 bp, Glycine max
  unsure (1)..(294): unsure at all n locations
tcgcangcagncgtacgtaagctcggaattcggctcganganaggtgnctgcacttcacctgggcaaacttggcnctaagctgacccancttagcaagtcccaggctgattacatcagtgtgcncgttgagggtccatacaagcctgctcantannggtactaagtgattgagatgatcaactgaaaagtgagtgagggaaagacaaaaatcggttttatcaatcggatttgattgtttaattttccttttttgatttttggtgttngacttttcagaatgtggtagaagaatt

SEQ ID NO: 3185 - DNA, 245 bp, Glycine max
  unsure (1)..(245): unsure at all n locations
gatggcgttgttggttgagaaaacaagcagtggaagggagtacancgtgaaggncatgacgcaagccgntttcggaagattggaaatcgagctggcggaggttgaaatggcccggcatcatgtccctcccggcaccgngttcggcccctcttcaacccttcaagggcgcnangatnaccggntccctccacaatgagcnnncaaanagccgtacctnaaacgnagacncgcacnngccngggggc

SEQ ID NO: 3186 - DNA, 234 bp, Glycine max
  unsure (1)..(234): unsure at all n locations
aaaannanangtngcatgcacgcgtacgtaagctcggaattcggctcgnnctcgagccgaatcggctcgactttctctagtcctgttatttctcagcgcgtaaagcatgnctttgttggtggagaaaacanacgagtggtcgcgagtacaaggtcaaggacctttcccaggccgacttcggccgcntcgagatcgagctggccgaggttgagatgcccggcctcatggcctgtn

SEQ ID NO: 3187 - DNA, 298 bp, Glycine max
  unsure (1)..(298): unsure at all n locations
tcgcnngcacgcgtacgtnagctcgnanttcggcnccgagtggnaggaggtaaggctgggtcgacccagatctagttgagctcaccaactcccgctcccatttccttatttatagacagagtctgattgtttcctcaccactccctccantctctttctctagtcctgttatttctcagcgcgtaaagcatggctttgttggtggagaaaaccacgagtggtcgcgagtacaaggtcaaggacctttcccaggccgacttcggccgcctcgagatcgagctggccgaggttgagatgc

SEQ ID NO: 3188 - DNA, 221 bp, Glycine max
  unsure (1)..(221): unsure at all n locations
tntgtcgcatncacgcgtacgtaagctcggaattnggctcgnnctcganccgctncgagccgctcgagccggtcctgtnatntctcagcgcgtaaagcatggctttanttggtgganaaaaccacgagtggtcgcgagtacaaggtcaaggacctttcccaggccgacttcgggcccctncgagatcgagctggccgaggttgagatgcccggcctcatgg

SEQ ID NO: 3189 - DNA, 291 bp, Glycine max
  unsure (1)..(291): unsure at all n locations
anncananaatnatgcacgcgtacgtaagctcggaattcggctcgagattgtttcctcaccactccctccantctctttctctagtcctgttatttctcagcgcgtaaagcatggctttgttggtggagaaaaccacgagtggtcganagtaanaaggtcaaggactttcccaggccgacttcggcngcctcgagatcgagctggccgaggttnaaatgccgggcctcatggctggncggacgattngggcccctcnaancctttaaggggggccnaaatcangggntccn

SEQ ID NO: 3190 - DNA, 303 bp, Glycine max
  unsure (1)..(303): unsure at all n locations
ncgcgatgcagcgtacgtaagctcggaattcggctcgaggttatttctcagcgcgtaaagcatggctttgtnggtggagaaaaccacgagtggtcgcgagtacaaggtcaaggacctttcccaggccgacttcggccgcctcgagattcgagctggnccgaggttgagatgcccggacctcatggcctgtncggaccgagttnggncccctacccagccctttcaagggggncccgcatcaccggcncccnccacatgnaccatccagtgccgnccgttgttcattgngnaccctgcaccgcc

SEQ ID NO: 3191 - DNA, 144 bp, Glycine max
  unsure (1)..(144): unsure at all n locations
ngcaggcacgcgtacgtaagctncggaattcggctcgagncggctcgaggggttgtgctgctgcattgaagcaggctggtgctcgtgtcatcgtgactgagattgaccccatttgtgcccttcaggctctcatggaagggcctt

SEQ ID NO: 3192 - DNA, 134 bp, Glycine max
  unsure (1)..(134): unsure at all n locations
aacgtcgcatgcacgcgtacgtaagctcggaattcggctcgagcccgacctnatcgtcgacgacggtggtgacgctacccttctcatgccacgaaggcnttnaggccgaggagctctatgagaagaccggcgaa

SEQ ID NO: 3193 - DNA, 303 bp, Glycine max
  unsure (1)..(303): unsure at all n locations
acgtcgcatgcacgcgtacgtaagctcggaattcggctcgaggcttagcaagtcccagggctgattacatcagtgtgcctgttgagggtccatacaagcctgctcactacaggtactaagtgattganatgatcaactgaaaagtgagtgagggaaagacaaaaatcggttttatcaatcggatttgattgtttaattttcctttttttgatttttggtgttagacttttcagatttgtggtagaagaatgtagccatttttatttctgtagaacttttgttcggtgggtgggaccagtaagg

SEQ ID NO: 3194 - DNA, 315 bp, Glycine max
  unsure (1)..(315): unsure at all n locations
tagcangcacgcgtacgtaagctcggaattcggctcgaggggtcgtttgatgaacttggggtgtgccacgggacaccccagctttgtgatgtcgtgctccttcaccaaccaggtcatngctcagcttgaattgtggaaagagaagggttctgggaagtatgagaagaaggtgnatgtgttgcccaagcaccttgacgngaaagtggcttctctccaccttggccagnttggagctaggctcaccaagctttccanagaccaagctgattacatcagtgtgcctgttgagggtccatacaagccgctccncacagt

SEQ ID NO: 3195 - DNA, 290 bp, Glycine max
  unsure (1)..(290): unsure at all n locations
cancacactcgcangcacgcgtacgtaagctcggaattcggctcgagcaggtcattgctcagcttgaattgtggaaagagaagggttctgggaagtatgagaagaaggtgtatgtgttgcccaagcaccttgacgagaaagtggcttctctccaccttggccagcttggagctaggctcaccaagctttccaaagaccaagctgattacatcagtgtgcctgttgagggtccatacaagcctgctcactacaggtactgatccatcctattgggggagaataaacctaaa

SEQ ID NO: 3196 - DNA, 217 bp, Glycine max
  unsure (1)..(217): unsure at all n locations
gtcgcangcacgcgtacgtaagctcggaattcggctcgagctcagcttgaattgtggaaagagaagggttctgggaagtatgagaagaaggtgtatgtgttgcccaagcaccttgacgagaaagtggcttctctccaccttggccagcttggagctaggctcaccaagctttccaaagaccaagctgattacatcagtgtgcctgttgagggtccat

SEQ ID NO: 3197 - DNA, 255 bp, Glycine max
  unsure (1)..(255): unsure at all n locations
gaaagagaagggttctgggaagtatgagaagaaggtgtatgtgttgcccaagcaccttgacgagaaagtggcttctctccaccttggccagcttggagctaggctcaccaagctttccaaagaccagctgattacatcagtgtgctgttgangggggccataanagcttgtcnctnanggnnnnggnccnncctttgggggggaannaacccgaantntntttnattcggggggggnttgtnnantttnnttnng

SEQ ID NO: 3198 - DNA, 338 bp, Glycine max
  unsure (1)..(338): unsure at all n locations
aggaccatgccgccgccgccatcgcccgcgacaggcctccgtcttcgcctggaagggtgagaccctccaggaatactggtggtgcaccgagcgcgcctcgactgggnnccccggcggcggcccgatctcatcgtcgacgacggcggcgacaccactcttctcattcacgagggcgtcaaggccgaggagatctttgagaagaccggccagttccccgacccggcttcctccgacaatgcggattcncgatcgtgctgagcatcatcagggatggttgaagaccgatcccaagaggtaccacaagatgaagacagaatcgtcggtgtctccgaagaaac

SEQ ID NO: 3199 - DNA, 317 bp, Glycine max
  unsure (1)..(317): unsure at all n locations
agtcgcatgcacgcgtacgtaagctcggaattcggctcgaggcctggaagggtgagaccctccaggaatactggtggtgcaccgagcncgccctcgactggngccccggcggcggccccganctcatcgtccgacgacggcggcgacaccactcttctcattcacgagggcgtcaaggccgaggagatctttgagaagaccggccagttccccgacccggcttcctccgacaatgcggagttccagatcgtgctgagcatcattcagggatggcttgaagaccgatcccaagaggtaccacaagatgaaggacagaa

SEQ ID NO: 3200 - DNA, 290 bp, Glycine max
  unsure (1)..(290): unsure at all n locations
gtcgcangcacgcgtacgtaagctcggaattcggctcgagggaatatccactagcttcgtggaggtgacggatcttgacatggttgatgctnccatagtagaagggaaaacaaaagtggctttacttcgaatctgtttccaaccccacccttacggttgcgaacatacctgaactgtgccacatggcacaccggaagggagtgacggtggtggtggacaacacgttcgcgcccatggtgctttcgccagcgcgtcttggtgctgatgttgtcgttcacagtatctccaag

SEQ ID NO: 3201 - DNA, 213 bp, Glycine max
attcggctcgaggcggaatatccactagcttcgtggaggtgacggatcttgacatggttgatgctgccatagtagaagggaaaacaaaagtgctttacttcgaatctgtttccaaccccacccttacggttgcgaacatacctgaactgtgccacatggcacaccggaagggagtgacggtggtggtggacaacacgttcgcgcccatggtgc

SEQ ID NO: 3202 - DNA, 297 bp, Glycine max
  unsure (1)..(297): unsure at all n locations
cncangcacgcgtacgtaagctcggaattcggctcgaggtgggacccacgcgctcctctcacactttctcccgcgcacgtgcggaatatccactagcttcgtggaggtgacggatcttgacatggttgatgctgccatagtagaagggaaaacaaaagtgctttacttcgaatctgtttccaaccccacccttacggttgcgaacatacctgaactgtgccacatggcacaccggaagggagtgacggtggtggtggacaacacgttcgcgcccatggtgctttcgccagcgcgtct

SEQ ID NO: 3203 - DNA, 300 bp, Glycine max
  unsure (1)..(300): unsure at all n locations
gtcncnngtacgtaanctcggaattcggctcgagcngacaancccaanncccaagcccaacaatctgcatccccggccgcggcccgtgcaaccaaatgggccgtggacagctggaagtccaagaaggccctgcagntgcccgaataccccaaccaggaggatctcgaggccgtcctccgcaccctcgacgcntncccctcanatcgtcttcgccggcgaggcccgganactcgaggagcacctcgccgaggccgccatnggaaatgcnttcttccncnanggcgnagatgtnccnagagt

SEQ ID NO: 3204 - DNA, 434 bp, Glycine max
  unsure (1)..(434): unsure at all n locations
ccacgcgtccgcccacgcgtccggtccgccatctccgccgtcctnctccagctctgcagccacngcgaacanggtggtcgnctccagaactctntacngtgggacccacncgctcctctcacactttctcccgcgcacgtgcggaatatccactagcttcgtggaggtgacngatcttgacatggnttatgctgccataatagaaaggaaaacaaaagtgctttacttntaatctggttccaaccccacccttacngttgcgaacatacctgaactgtgccacatggcacaccggaagggagtgactgtggtggtggacaacacgttcgtgcccatggtgctttcgccagcgcgtntttggtgcttatgtttgtncttcacagtatctccaagttcatnaatnggtggggcccgatattattgcangagcggng

We claim:

1. A substantially purified nucleic acid molecule that encodes a maize S-adenosyl-methionine decarboxylase fragment wherein said nucleic acid molecule comprises a nucleic acid sequence which shares between 100% and 95% sequence identity with SEQ ID NO: 662.

2. A substantially purified nucleic acid molecule comprising a nucleic acid sequence which shares between 100% and 95% sequence identity with SEQ ID NO: 662 or complete complement thereof.

3. The substantially purified nucleic acid molecule of claim 2, wherein said substantially purified nucleic acid molecule comprises a nucleic acid sequence which shares between 100% and 98% sequence identity with SEQ ID NO: 662 or complete complement thereof.

4. The substantially purified nucleic acid molecule of claim 2, wherein said substantially purified nucleic acid molecule comprises a nucleic acid sequence which shares between 100% and 99% sequence identity with SEQ ID NO: 662 or complete complement thereof.

5. The substantially purified nucleic acid molecule of claim 2, wherein said substantially purified nucleic acid molecule comprises a nucleic acid sequence with 100% sequence identity with SEQ ID NO: 662 or complete complement thereof.

6. A transformed plant comprising a nucleic acid molecule which comprises:
   (a) an exogenous promoter region which functions in a cell of the plant to cause the production of an mRNA molecule, which is linked to,
   (b) a structural nucleic acid molecule, wherein said structural mucleic acid molecule comprises a nucleic acid sequence which shares between 100% and 95% sequence identity with SEQ ID NO: 622 or complete complement thereof, which is linked to
   (c) a 3' non-translated sequence that functions in the plant cell to cause the termination of transcription and addition of polyadenylated ribonucleotides to the 3' end of the mRNA molecule.

7. The transformed plant of claim 6, wherein said nucleic acid molecule comprises a nucleic acid sequence which shares between 100% and 98% sequence identity with SEQ ID NO: 662 or complete complement thereof.

8. The transformed plant of claim 6, wherein said nucleic acid molecule comprises a nucleic acid sequence which shares between 100% and 99% sequence identity with SEQ ID NO: 662 or complete complement thereof.

9. The transformed plant of claim 6, wherein said nucleic acid molecule comprises a nucleic acid sequence with 100% sequence identity with SEQ ID NO: 662 or complete complement thereof.

10. A transformed seed comprising a transformed plant cell comprising a nucleic acid molecule which comprises:
    (a) an exogenous promoter region which functions in said plant cell to cause the production of an mRNA molecule; which is linked to;
    (b) a structural nucleic acid molecule, wherein said structural nucleic acid molecule comprises a nucleic acid sequence, wherein said nucleic acid sequence shares between 100% and 95% sequence identity with SEQ ID NO: 662 or complete complement thereof, which is linked to
    (c) a 3' non-translated sequence that functions in said plant cell to cause the termination of transcription and the addition of polyadenylated ribonucleotides to said 3' end of said mRNA molecule.

11. The transformed seed according to claim 10, wherein said nucleic acid sequence is the complement of a nucleic acid sequence of SEQ ID NO: 662.

12. The transformed seed according to claim 10, wherein said exogenous promoter region functions in a seed cell.

13. The transformed seed according to claim 10, wherein said nucleic acid sequence shares between 100% and 98% sequence identity with SEQ ID NO: 662 or complete complement thereof.

14. The transformed seed according to claim 10, wherein said nucleic acid sequence shares between 100% and 99% sequence identity with SEQ ID NO: 662 or complete complement thereof.

15. The transformed seed according to claim 10, wherein said nucleic acid sequence shares 100% sequence identity with SEQ ID NO: 662 or complete complement thereof.

* * * * *